US007622564B2

(12) United States Patent
Ge et al.

(10) Patent No.: US 7,622,564 B2
(45) Date of Patent: Nov. 24, 2009

(54) PROSTATE STEM CELL ANTIGEN (PSCA) VARIANTS AND SUBSEQUENCES THEREOF

(75) Inventors: Wangmao Ge, Los Angeles, CA (US); Pia M. Challita-Eid, Encino, CA (US); Arthur B. Raitano, Los Angeles, CA (US); Aya Jakobovits, Beverly Hills, CA (US)

(73) Assignee: Agensys, Inc., Santa Monica, CA (US)

( * ) Notice: Subject to any disclaimer, the term of this patent is extended or adjusted under 35 U.S.C. 154(b) by 872 days.

(21) Appl. No.: 10/857,484

(22) Filed: May 28, 2004

(65) Prior Publication Data

US 2006/0029940 A1  Feb. 9, 2006

Related U.S. Application Data

(60) Provisional application No. 60/475,064, filed on May 30, 2003.

(51) Int. Cl.
*C07H 21/02* (2006.01)
*C07H 21/04* (2006.01)
*C12N 5/00* (2006.01)
*C12N 1/21* (2006.01)
*C12N 1/15* (2006.01)

(52) U.S. Cl. ............ 536/23.1; 536/23.5; 435/325; 435/252.3; 435/254.11

(58) Field of Classification Search .................. None
See application file for complete search history.

(56) References Cited

U.S. PATENT DOCUMENTS

| 6,258,939 | B1 | 7/2001 | Reiter et al. | |
|---|---|---|---|---|
| 6,635,468 | B2 | 10/2003 | Ashkenazi et al. | |
| 6,824,780 | B1 | 11/2004 | Devaux et al. | |
| 6,979,730 | B2* | 12/2005 | Reiter et al. | 536/23.1 |
| 2003/0023054 | A1 | 1/2003 | Ashkenazi et al. | |
| 2004/0018571 | A1 | 1/2004 | Reiter et al. | |

FOREIGN PATENT DOCUMENTS

| EP | 1 514 876 | 3/2005 |
|---|---|---|
| WO | WO 98/00540 | 1/1998 |
| WO | WO-98/40403 | 9/1998 |
| WO | WO-98/51805 | 11/1998 |
| WO | WO 98/51805 | 11/1998 |
| WO | WO 98/51824 | 11/1998 |
| WO | WO-01/40309 | 6/2001 |
| WO | WO-03/074654 | 9/2003 |

OTHER PUBLICATIONS

Strausberg, R. (Accession No. BI763933, GI: 1575511 Sep. 25, 2001).*
Arlen et al., Critical Review in Immunology (1998) 18:133-138.
Arthur et al., Cancer Gene Therapy (1997) 4:17-25.
Ashley et al., Journal of Experimental Medicine (1997) 186:1177-1182.
Bamezai and Rock, Nat'l. Acad. Sci USA (1995) 92:4294-4298.
Brakenhoff et al., Journal of Cell Biology (1995) 129:1677-1689.
Braun et al., Molecular and Cell Biology (1995) 15:4623-4630.
Cher et al., Genes Chromosomes and Cancer (1994) 11:153-162.
Cohen et al., Proc. Nat'l. Acad. Sci. USA (1972) 69:2110-2114.
Cupp and Oesterling, Mayo Clinic Proceedings, (1993) 68:297-306.
Deleersnijder et al., Journal of Biological Chemistry (1996) 271:19475-19482.
Fields and Song, Nature (1989) 340:245-246.
Fong et al., Journal of Immunology (1997) 159:3113-3117.
Foon et al., Journal of Clinical Investigation (1995) 96:334-342.
Fritz and Lowe, American Journal of Physiology (1996) 270:G176-G183.
Funakoshi et al., Journal of Immunotherapy (1996) 19(2):93-101.
Graham and Van Der Eb, Virology (1973) 52:456-467.
Liu et al., Cancer Research (1998) 58:4055-4060.
Henderson et al., Cancer Research (1996) 56:3763-3770.
Herlyn et al., Cancer Immunology Immunotherapy (1996) 43:65-76.
Hodge et al., International Journal of Cancer (1995) 63:231-237.
Israeli et al., Cancer Research (1993) 53:227-230.
Jenkins et al., Cancer Research (1997) 57:524-531.
Kasprzyk et al., Cancer Research (1992) 52:2771-2776.
Katz et al., International Journal of Cancer (1994) 59:684-691.
Kieffer et al., Biochemistry (1994) 33:4471-4482.
Klein et al., Nature Medicine (1997) 3:402-408.
Lalani et al., Cancer and Metastasis Reviews (1997) 16:29-66.
Lee and Oesterling, "Cancer of the Prostate: Diagnosis and Staging," in Urologic Oncology, Oesterling and Richie (eds.), (1997) pp. 357-377.
Magi-Galluzzi et al., Laboratory Investigation (1997) 76:37-51.
Mao et al., Proc. Nat'l. Acad. Sci. USA (1996) 93:5910-5914.
Mount et al., Cancer Research (1994) 54:6160-6166.
Noda et al., Journal of Experimental Medicine (1996) 183:2355-2360.
Ozaki et al., Blood (1997) 90:3179-3186.
Qian et al., Cancer Research (1995) 55:5408-5414.
Restifo, Current Opinion in Immunology (1996) 8:658-663.
Ribas et al., Cancer Research (1997) 57:2865-2869.

(Continued)

*Primary Examiner*—Karen A Canella
*Assistant Examiner*—Peter J Reddig
(74) *Attorney, Agent, or Firm*—Morrison & Foerster LLP

(57) ABSTRACT

PSCA and its encoded protein, and variants thereof, are described wherein PSCA exhibits tissue specific expression in normal adult tissue, and is aberrantly expressed in the cancers listed in Table I. Consequently, PSCA provides a diagnostic, prognostic, propylactic and/or therapeutic target for cancer. The PSCA gene or fragment thereof, or its encoded protein, or variants thereof, or a fragment thereof, can be used to elicit a humoral or cellular immune response; antibodies or T cells reactive with PSCA can be used in active or passive immunization.

4 Claims, 48 Drawing Sheets

OTHER PUBLICATIONS

Rowley et al., Proc. Nat'l. Acad. Sci. USA (1990) 87:9358-9362.
Shepard et al., Journal of Clinical Immunology (1991) 2:117-127.
Southern and Berg, Journal of Molecular and Applied Genetics (1982) 1:327-341.
Southern, Journal of Molecular Biology (1975) 98:503-517.
Thomas and Samelson, The Journal of Biological Chemistry (1992) 267:12317-12322.
Thorpe and Ross, Immunological Review (1982) 62:119-158.
Towbin et al., Proc. Nat'l. Acad. Sci. USA (1979) 76:4350-4354.
Tsunenari et al., Blood (1997) 90:2437-2444.
Udenfriend and Kodukula, Annual Review of Biochemistry (1995) 64:563-591.
Veis et al., Cell (1993) 75:229-240.
Velders et al., Cancer Research (1995) 55:4398-4403.
Wagner et al., Hybridoma (1997) 16:33-40.
Wigler et al., Proc. Nat'l. Acad. Sci. USA (1979) 76:1373-1376.
Yang et al., American Journal of Pathology (1997) 150:693-704.
Zhong et al., Leukemia Research (1996) 20:581-589.
Boulianne et al., Nature (1984) 312:643-646.
Fell et al., Proc. Nat'l. Acad. Sci. USA (1989) 86:8507-8511.
Hellstrom et al., Proc. Nat'l. Acad. Sci. USA (1985) 82:1499-1502.
Hellstrom et al., "Antibodies for Drug Delivery," in Controlled Drug Delivery, 2$^{nd}$ ed., Robinson et al. (eds.), (1987) pp. 623-653.
Neuberger et al., Nature (1984) 312:604-608.
Sahagan et al., The Journal of Immunology (1986) 137:1066-1074.
Sharon et al., Nature (1984) 309:364-367.
Shizuya et al., Proc. Nat'l. Acad. Sci. USA (1992) 89:8794-8797.
Tan et al., The Journal of Immunology (1985) 135:3564-3567.
Vitetta et al., "Immunotoxin Therapy," in Cancer: Principles and Practice of Oncology, 4th edition, DeVita Jr., et al., (eds,), (1993) pp. 2624-2636.
Algate et al., Blood (1994) 83(9):2459-2468.
Arnon et al., "Monoclonal Antibodies for Immunotargeting of Drugs in Cancer Therapy," in Monoclonal Antibodies and Cancer Therapy, Reisfeld and Sell (eds.), (1985) pp. 243-256.
Bacchetti and Graham, Proc. Nat'l. Acad. Sci. USA (1977) 74(4):1590-1594.
Berent et al., BioTechniques (1985) 3:208-219.
Berkner, BioTechniques (1988) 6(7):616-626.
Bonkhoff and Remberger, The Prostate (1996) 28(2):98-106.
Bonkhoff et al., The Prostate (1994) 24:114-118.
Boshart et al., Cell (1985) 41(2):521-530.
Breviario et al., The Journal of Biological Chemistry (1992) 267(31):22190-22197.
Brinster et al., Cell (1984) 37:367-379.
Brinster et al., Proc. Nat'l. Acad. Sci. USA (1988) 85:836-840.
Cluitmans et al., Annals of Hematology (1994) 68:293-298.
De Wit et al., British Journal of Hematology (1994) 86:259-264.
DePamphilis et al., BioTechniques (1988) 6(7):662-680.
Espinoza-Delgado et al., the Journal of Immunology (1992) 149(9):2961-2968.
Felgner et al., Proc. Nat'l. Acad. Sci. USA (1987) 84:7413-7417.
Felgner et al., Proceedings of the Western Pharmacology Society (1989) 32:115-121.
Freireich et al., Cancer Chemotherapy Reports (1966) 50(4):219-244.
Gao et al., The Prostate (1997) 31:264-281.
Garabedian et al., Proc. Nat'l. Acad. Sci. USA (1998) 95:15382-15387.
Geller et al., Proc. Nat'l. Acad. Sci. USA (1990) 87:8950-8954.
Ghosh-Choudhury et al., Gene (1986) 50:161-171.
Greenberg et al., Proc. Nat'l. Acad. Sci. USA (1995) 92:3439-3443.
Hock and Miller, Nature (1986) 320:275-277.
Horisberger et al., Journal of Virology (1990) 64(3):1171-1181.
Kaufman, Proc. Nat'l. Acad. Sci. USA (1985) 82:689-693.
Kaufman, Methods in Enzymology (1990) 185:487-511.
Kay et al., Journal of Experimental Medicine (1991) 173:775-778.
Lagoo et al., The Journal of Immunology (1994) 152(4):1641-1652.
Li and Stashenko, The Journal of Immunology (1992) 148(3):788-794.
Martinez et al., Transplantation (1993) 55(5):1159-1166.
Mauviel et al., The Journal of Immunology (1992) 149(9):2969-2976.
Maxam and Gilbert, Methods in Enzymology (1980) 65:499-560.
Maroulakou et al., Proc. Nat'l. Acad. Sci. USA (1994) 91:11236-11240.
Murphy et al., The Prostate (1996) 29:371-380.
Pang et al., Clinical and Experimental Immunology (1994) 96:437-443.
Panicali and Paoletti, Proc. Nat'l. Acad. Sci. USA (1982) 79:4927-4931.
Pizarro et al., Transplantation (1993) 56(2):399-404.
Rosenfeld et al., Science (1991) 252:431-434.
Sarver et al., Molecular and Cellular Biology (1981) 1(6):486-496.
Schaefer-Ridder et al., Science (1982) 215:166-168.
Shimane et al., Biochemical and Biophysical Research Communications (1994) 199:26-32.
Smith et al., Nature (1993) 302:490-495.
Sprecher and Becker, Archives of Virology (1992) 126:253-269.
Stavridis et al., Experimental Cell Research (1986) 164:568-572.
Tjoa et al., The Prostate (1996) 28:65-69.
Ulich et al., The Journal of Immunology (1991) 146(7):2316-2323.
Wong et al., Science (1985) 228:810-815.
Bzdega et al., Journal of Neurochemistry (1997) 69(6):2270-2277.
Caron et al., Journal of Experimental Medicine (1992) 176(4):1191-1195.
Carter et al., Proc. Nat'l. Acad. Sci. USA (1992) 89:4285-4289.
Carter et al., Proc. Nat'l. Acad. Sci. USA (1996) 93:749-753.
Coloma et al., Journal of Immunological Methods (1992) 152:89-104.
Hooijberg et al., Cancer Research (1995) 55:2627-2634.
Huang et al., Cancer Research (1995) 55:610-616.
Israeli et al., Cancer Research (1994) 54(7):1807-1811.
Jenkins et al., Cancer Research (1997) 57(3):524-531.
Jones et al., Nature (1986) 321:522-525.
Larson et al., International Journal of Cancer (1988) 42(6):877-882.
Morton and Myszka, Methods in Enzymology (1998) 295:268-294.
Riechmann et al., Nature (1988) 332:323-327.
Shopes, The Journal of Immunology (1992) 148:2918-2922.
Sims et al., The Journal of Immunology (1993) 151(4):2296-2308.
Slovin et al., Program/Proceedings American Society of Clinical Oncology (1997) 16:311a.
Su et al., Proc. Nat'l. Acad. Sci. USA (1996) 93:7252-7257.
Towbin et al., Proc. Nat'l. Acad. Sci. USA (1979) 76(9):4350-4354.
Vaughan et al., Nature Biotechnology (1998) 16:535-539.
Verhoeyen et al., Science (1988) 239:1534-1536.
Wolff et al., Cancer Research (1993) 53(11):2560-2565.
Yang et al., Cancer Research (1999) 59(6):1236-1243.
Cama et al., The Journal of Urology (1995) 153:1373-1378.
Horoszewicz et al., Anticancer Research (1987) 7:927-936.
Israeli et al., Cancer Research (1994) 54:6306-6310.
Smith et al., Cancer Research (1995) 55:2640-2644.
Sodee et al., Clinical Nuclear Medicine (1996) 21:759-767.
Wu, Journal of Clinical Laboratory Analysis (1994) 8:51-62.
Muller et al., Molec. Cell. Biol. (1991) 11:1785-1792.
Zhigang et al., World Journal of Surgical Oncology (2004) 2:13.
Matsueda et al., The Prostate (2004) 60:205-213.
Abaza et al., Journal of Protein Chemistry (1992) 11(5):433-444.
Burgess et al., Journal of Cell Biology (1990) 111:2129-2138.
Coleman et al., Research in Immunology (1994) 145:33-36.
Rudikoff et al., PNAS USA (1982) 79:1979-1983.
Dannull et al., Cancer Research (2000) 60(19):5522-5528.
International Preliminary Report on Patentability for PCT/US2006/005693, mailed Oct. 25, 2007, 9 pages.
Kiessling et al., International Journal of Cancer (2002) 102(4):390-397.
Ross et al., Cancer Research (2002) 62(9):2546-2553.
Supplementary Partial European Search Report for EP 04785910.3, mailed Feb. 29, 2008, 5 pages.
Gu et al., Oncogene (2000) 19:1288-1296.
International Search Report for PCT/US05/17412, mailed on Dec. 16, 2005, 4 pages.
Nucleic acid sequence database from issued US patents, Jul. 10, 2001, 98.9% identical to Seq ID No. 1.

Saffran et al., PNAS (2001) 98(5):2658-2663.
Lam et al., Clin. Cancer Res. (2005) 11(7):2591-2596.
International Search Report for PCT/US04/17231, mailed on Jan. 19, 2007, 4 pages.
Written Opinion for PCT/US04/17231, mailed on Jan. 19, 2007, 3 pages.
Bahrenberg et al., Biochem Biophys Res Commun (2000) 275(3):783-788.

Reiter et al., PNAS USA (1998) 95:1735-1740.
Office Action for European Patent Application No. 04 785 910.3, mailed on Jan. 29, 2009, 5 pages.
Office Action for Russian Patent Application No. 2006146666, mailed on Dec. 11, 2008, 7 pages [English translation included].

* cited by examiner

Figure 2:

Figure 2A. The cDNA (SEQ ID. NO. :6529) and amino acid sequence (SEQ ID. NO. :6532) of PSCA v.1. The Kozak sequence is shown in bold, the start methionine is underlined. The open reading frame extends from nucleic acid 18-389 including the stop codon.

```
      1                 M  K  A  V  L  L  A  L  L  M  A  G  L  A  L
      1 agggagaggcagtgaccATGAAGGCTGTGCTGCTTGCCCTGTTGATGGCAGGCTTGGCCC
     16 Q  P  G  T  A  L  L  C  Y  S  C  K  A  Q  V  S  N  E  D  C
     61 TGCAGCCAGGCACTGCCCTGCTGTGCTACTCCTGCAAAGCCCAGGTGAGCAACGAGGACT
     36 L  Q  V  E  N  C  T  Q  L  G  E  Q  C  W  T  A  R  I  R  A
    121 GCCTGCAGGTGGAGAACTGCACCCAGCTGGGGGAGCAGTGCTGGACCGCGCGCATCCGCG
     56 V  G  L  L  T  V  I  S  K  G  C  S  L  N  C  V  D  D  S  Q
    181 CAGTTGGCCTCCTGACCGTCATCAGCAAAGGCTGCAGCTTGAACTGCGTGGATGACTCAC
     76 D  Y  Y  V  G  K  K  N  I  T  C  C  D  T  D  L  C  N  A  S
    241 AGGACTACTACGTGGGCAAGAAGAACATCACGTGCTGTGACACCGACTTGTGCAACGCCA
     96 G  A  H  A  L  Q  P  A  A  A  I  L  A  L  L  P  A  L  G  L
    301 GCGGGGCCCATGCCCTGCAGCCGGCTGCCGCCATCCTTGCGCTGCTCCCTGCACTCGGCC
    116 L  L  W  G  P  G  Q  L  *
    361 TGCTGCTCTGGGGACCCGGCCAGCTATAGgctctgggggccccgctgcagcccacactg
    421 ggtgtggtgccccaggcctttgtgccactcctcacagaacctggcccagtgggagcctgt
    481 cctggttcctgaggcacatcctaacgcaagtttgaccatgtatgtttgcaccccttttcc
    541 ccnaaccctgaccttcccatgggccttttccaggattcccacccggcagatcagttttag
    601 tgacacagatccgcctgcagatggcccctccaaccctttctgttgctgtttccatggccc
    661 agcattttccaccctttaaccctgtgttcaggcacttcttcccccaggaagccttccctgc
    721 ccacccatttatgaattgagccaggtttggtccgtggtgtccccgcacccagcagggg
    781 acaggcaatcaggagggcccagtaaaggctgagatgaagtggactgagtagaactggagg
    841 acaagagttgacgtgagttcctgggagtttccagagatggggcctggaggcctggaggaa
    901 ggggccaggcctcacatttgtggggctcccgaatggcagcctgagcacagcgtaggccct
    961 taataaacacctgttggataagccaaaaaa
```

Figure 2B. The cDNA (SEQ ID. NO. :6527) and amino acid sequence (SEQ ID. NO. :6530) of PSCA v.2. The Kozak sequence is shown in bold, the start methionine is underlined. The open reading frame extends from nucleic acid 56-427 including the stop codon.

```
  1                                                             M   K
  1 tttgaggccatatataaagtcacctgaggccctctccaccacagcccaccagtgaccATGAA
  3   A   V   L   L   A   L   L   M   A   G   L   A   L   Q   P   G   T   A   L   L
 61 GGCTGTGCTGCTTGCCCTGTTGATGGCAGGCTTGGCCCTGCAGCCAGGCACTGCCCTGCT
 23   C   Y   S   C   K   A   Q   V   S   N   E   D   C   L   Q   V   E   N   C   T
121 GTGCTACTCCTGCAAAGCCCAGGTGAGCAACGAGGACTGCCTGCAGGTGGAGAACTGCAC
 43   Q   L   G   E   Q   C   W   T   A   R   I   R   A   V   G   L   L   T   V   I
181 CCAGCTGGGGAGCAGTGCTGGACCGCGCGCATCCGCGCAGTTGGCCTCCTGACCGTCAT
 63   S   K   G   C   S   L   N   C   V   D   D   S   Q   D   Y   Y   V   G   K   K
241 CAGCAAAGGCTGCAGCTTGAACTGCGTGGATGACTCACAGGACTACTACGTGGGCAAGAA
 83   N   I   T   C   C   D   T   D   L   C   N   A   S   G   A   H   A   L   Q   P
301 GAACATCACGTGCTGTGACACCGACTTGTGCAACGCCAGCGGGGCCCATGCCCTGCAGCC
103   A   A   A   I   L   A   L   L   P   A   L   G   L   L   L   W   G   P   G   Q
361 GGCTGCCGCCATCCTTGCGCTGCTCCCTGCACTCGGCCTGCTGCTCTGGGGACCCGGCCA
123   L   *
421 GCTATAGgctctggggggccccgctgcagcccacactgggtgtggtgccccaggcctctg
481 tgccactcctcacacacccggcccagtgggagcctgtcctggttcctgaggcacatccta
541 acgcaagtctgaccatgtatgtctgcgccctgtccccaccctgaccctcccatggccc
601 tctccaggactcccacccggcagatcggctctattgacacagatccgcctgcagatggcc
661 cctccaaccctctctgctgctgtttccatggcccagcattctccacccttaaccctgtgc
721 tcaggcacctcttcccccaggaagccttccctgcccaccccatctatgacttgagccagg
781 tctggtccgtggtgtccccgcacccagcagggacaggcactcaggaggggcccggtaaa
841 ggctgagatgaagtggactgagtagaactggaggacaggagtcgacgtgagttcctggga
901 gtctccagagatggggcctggaggcctggaggaaggggccaggcctcacattcgtggggc
961 tccctgaatggcagcctcagcacagcgtaggcccttaataaacacctgttggataagcca
```

Figure 2C. The cDNA (SEQ ID. NO. :6533) and amino acid sequence (SEQ ID. NO. :6536) of PSCA v.3. The Kozak sequence is shown in bold, the start methionine is underlined. The open reading frame extends from nucleic acid 423-707 including the stop codon.

```
  1 tttgaggccatataaagtcacctgaggccctctccaccacagcccaccagtgaccatgaa
 61 ggctgtgctgcttgccctgttgatggcaggcttggccctgcagccaggcactgccctgct
121 gtgctactcctgcaaagcccaggcgcagttggcctcctgaccgtcatcagcaaaggctgc
181 agcttgaactgcgtggatgactcacaggactactacgtgggcaagaagaacatcacgtgc
241 tgtgacaccgacttgtgcactcggcctgctgctctggggacccggccagctataggctct
301 ggggggccccgctgcagcccacactgggtgtggtgccccaggcctctgtgccactcctca
361 cacaccggcccagtgggagcctgtcctggttcctgaggcacatcctaacgcaagtctga
  1  M  Y  V  C  A  P  V  P  H  P  D  P  P  M  A  L  S  R  T  P
421 ccATGTATGTCTGCGCCCCTGTCCCCCACCCTGACCCTCCCATGGCCCTCTCCAGGACTC
 21  T  R  Q  I  G  S  I  D  T  D  P  P  A  D  G  P  S  N  P  L
481 CCACCCGGCAGATCGGCTCTATTGACACAGATCCGCCTGCAGATGGCCCCTCCAACCCTC
 41  C  C  F  H  G  P  A  F  S  T  L  N  P  V  L  R  H  L  F
541 TCTGCTGCTGTTTCCATGGCCCAGCATTCTCCACCCTTAACCCTGTGCTCAGGCACCTCT
 61  P  Q  E  A  F  P  A  H  P  I  Y  D  L  S  Q  V  W  S  V  V
601 TCCCCCAGGAAGCCTTCCCTGCCCACCCCATCTATGACTTGAGCCAGGTCTGGTCCGTGG
 81  S  P  A  P  S  R  G  Q  A  L  R  R  A  R  *
661 TGTCCCCCGCACCCAGCAGGGGACAGGCACTCAGGAGGGCCCGGTAAaggctgagatgaa
721 gtggactgagtagaactggaggacaggagtcgacgtgagttcctgggagtctccagagat
781 ggggcctggaggcctggaggaaggggccaggcctcacattcgtggggctccctgaatggc
841 agcctcagcacagcgtaggcccttaataaacacctgttggataagcca
```

Figure 2D. The cDNA (SEQ ID. NO. :6537) and amino acid sequence (SEQ ID. NO. :6540) of PSCA v.4. The start methionine is underlined. The open reading frame extends from nucleic acid 424-993 including the stop codon.

```
   1 gacagtgaaccctgcgctgaaggcgttggggctcctgcagttctggggcagccacaggcg
  61 cccaggqtttcgtgccgatcagcccaggacggtcttcccggtgcagtttctgatgcgggg
 121 agggcagtgctgccttccggtcaccaggaccagtgctcagcccgcctgcttgaccccctt
 181 acttagctggggtccaatccatacccaatttagatgattcagacgatgggatttgaaact
 241 tttgaactgggtgcgacttaagcactgccctgctgtgctactcctgcaaagcccaggtga
 301 gcaacgaggactgcctgcaggtggagaactgcacccagctggggagcagtgctggaccg
 361 cgcgcatccgcgcagttggcctcctgaccgtcatcagcaaaggctgcagcttgaactgcg
   1   M   T   H   R   T   T   T   W   A   R   R   T   S   R   A   V   T   P   T
 421 tgcATGACTCACAGGACTACTACGTGGGCAAGAAGAACATCACGTGCTGTGACACCGACT
  20   C   A   T   P   A   G   P   M   P   C   S   R   L   P   P   S   L   R   C   S
 481 TGTGCAACGCCAGCGGGGCCCATGCCCTGCAGCCGGCTGCCGCCATCCTTGCGCTGCTCC
  40   L   H   S   A   C   C   S   G   D   P   A   S   Y   R   L   W   G   A   P   L
 541 CTGCACTCGGCCTGCTGCTCTGGGGACCCGGCCAGCTATAGGCTCTGGGGGGCCCCGCTG
  60   Q   P   T   L   G   V   V   P   Q   A   S   V   P   L   L   T   H   P   A   Q
 601 CAGCCCACACTGGGTGTGGTGCCCCAGGCCTCTGTGCCACTCCTCACACACCCGGCCCAG
  80   W   E   P   V   L   V   P   E   A   H   P   N   A   S   L   I   M   Y   V   C
 661 TGGGAGCCTGTCCTGGTTCCTGAGGCACATCCTAACGCAAGTCTGACCATGTATGTCTGC
 100   A   P   V   P   H   D   P   P   M   A   L   S   R   T   P   T   R   Q   I
 721 GCCCCTGTCCCCCACCCTGACCCTCCCATGGCCCTCTCCAGGACTCCCACCCGGCAGATC
 120   G   S   I   D   T   D   P   P   A   D   G   P   S   N   P   L   C   C   C   F
 781 GGCTCTATTGACACAGATCCGCCTGCAGATGGCCCCTCCAACCCTCTCTGCTGCTGTTTC
 140   H   G   P   A   F   S   T   L   N   P   V   L   R   H   L   F   P   Q   E   A
 841 CATGGCCCAGCATTCTCCACCCTTAACCCTGTGCTCAGGCACCTCTTCCCCCAGGAAGCC
 160   F   P   A   H   P   I   Y   D   L   S   Q   V   W   S   V   V   S   P   A   P
 901 TTCCCTGCCCACCCCATCTATGACTTGAGCCAGGTCTGGTCCGTGGTGTCCCCCGCACCC
 180   S   R   G   Q   A   L   R   R   A   R   *
 961 AGCAGGGGACAGGCACTCAGGAGGGCCCGGTAAaggctgagatgaagtggactgagtaga
1021 actggaggacaggagtcgacgtgagttcctgggagtctccagagatggggcctggaggcc
1081 tggaggaaggggccaggcctcacattcgtggggctccctgaatggcagcctcagcacagc
1141 gtaggcccttaataaacacctgttggataagcca
```

Figure 2E. The cDNA (SEQ ID. NO. :6541) and amino acid sequence (SEQ ID. NO. :6544) of PSCA v.5. The start methionine is underlined. The open reading frame extends from nucleic acid 910-1479 including the stop codon.

```
   1 gacagtgaaccctgcgctgaaggcgttggggctcctgcagttctggggcagccacaggcg
  61 cccagggtttcgtgccgatcagcccaggacggtcttcccggtgcagtttctgatgcgggg
 121 agggcagtgctgccttccggtcaccaggaccagtgctcagcccgcctgcttgaccccctt
 181 acttagctggggtccaatccatacccaatttagatgattcagacgatgggatttgaaact
 241 tttgaactgggtgcgacttaagcactgccctgctgtgctactcctgcaaagccaggtga
 301 gcaacgaggactgcctgcaggtggagaactgcacccagctgggggagcagtgctggaccg
 361 cgcgcatccgtgagtgggggggacgacagccgccaggcctaggtctctgccactgaactat
 421 taatctttctggccatctgtccgcatctgtgtgctgttttccttccacctgtccccgacc
 481 cgtcccgcacctgcaccccaacaatcacccagcatctgtccctccagccatcctcctcc
 541 atctgccactcctccactcatctgtccctccccatcctccatcttccactcctccaccca
 601 tctgtccctccccatccctgagctcacttactcactcaccccatttctgacgctcagcgg
 661 gtggtccatctgcctcggacatctggataggctgagaccagggccgagaccaggccctc
 721 gcactgcttgcaatcctgaggccagcccaggggactctagagcattaggcagggtggga
 781 caggaggaggcctggggcaggtcaggcaggtgagcacacagggcagcccatccccggat
 841 cccgctgctcccaggcgcagttggcctcctgaccgtcatcagcaaaggctgcagcttga
     1        M  T  H  R  T  T  T  W  A  R  R  T  S  R  A  V  T
 901 actgcgtggATGACTCACAGGACTACTACGTGGGCAAGAAGAACATCACGTGCTGTGACA
    18 P  T  C  A  T  P  A  G  P  M  P  C  S  R  L  P  P  S  L  R
 961 CCGACTTGTGCAACGCCAGCGGGGCCCATGCCCTGCAGCCGGCTGCCGCCATCCTTGCGC
    38 C  S  L  H  S  A  C  C  S  G  D  P  A  S  Y  R  L  W  G  A
1021 TGCTCCCTGCACTCGGCCTGCTGCTCTGGGGACCCGGCCAGCTATAGGCTCTGGGGGGCC
    58 P  L  Q  P  T  L  G  V  V  P  Q  A  S  V  P  L  L  T  H  P
1081 CCGCTGCAGCCCACACTGGGTGTGGTGCCCCAGGCCTCTGTGCCACTCCTCACACACCCG
    78 A  Q  W  E  P  V  L  V  P  E  A  H  P  N  A  S  L  T  M  Y
1141 GCCCAGTGGGAGCCTGTCCTGGTTCCTGAGGCACATCCTAACGCAAGTCTGACCATGTAT
    98 V  C  A  P  V  P  H  P  D  P  P  M  A  L  S  R  T  P  T  R
1201 GTCTGCGCCCCTGTCCCCCACCCTGACCCTCCCATGGCCCTCTCCAGGACTCCCACCCGG
   118 Q  I  G  S  I  D  T  D  P  P  A  D  G  P  S  N  P  L  C  C
1261 CAGATCGGCTCTATTGACACAGATCCGCCTGCAGATGGCCCCTCCAACCCTCTCTGCTGC
   138 C  F  H  G  P  A  F  S  T  L  N  P  V  L  R  H  L  F  P  Q
1321 TGTTTCCATGGCCCAGCATTCTCCACCCTTAACCCTGTGCTCAGGCACCTCTTCCCCCAG
   158 E  A  F  P  A  H  P  I  Y  D  L  S  Q  V  W  S  V  V  S  P
1381 GAAGCCTTCCCTGCCCACCCCATCTATGACTTGAGCCAGGTCTGGTCCGTGGTGTCCCCC
   178 A  P  S  R  G  Q  A  L  R  R  A  R  *
1441 GCACCCAGCAGGGGACAGGCACTCAGGAGGGCCCGGTAAggctgagatgaagtggactg
1501 agtagaactggaggacaggagtcgacgtgagttcctgggagtctccagagatggggcctg
1561 gaggcctggaggaaggggccaggcctcacattcgtggggctccctgaatggcagcctcag
1621 cacagcgtaggcccttaataaacacctgttggataagcca
```

Figure 2F. The cDNA (SEQ ID. NO. :6545) and amino acid sequence (SEQ ID. NO. :6546) of PSCA v.6. The Kozak sequence is shown in bold, the start methionine is underlined. The open reading frame extends from nucleic acid 83-427 including the stop codon.

```
  1 tttgaggccatataaagtcacctgaggccctctccaccacagcccaccagtgaccatgaa
  1                                   M  A  G  L  A  L  Q  P  G  T  A  L  L
 61 ggctgtgctgcttgccctgttgATGGCAGGCTTGGCCCTGCAGCCAGGCACTGCCCTGCT
 14  C  Y  S  C  K  A  Q  V  S  N  E  D  C  L  Q  V  E  N  C  T
121 GTGCTACTCCTGCAAAGCCCAGGTGAGCAACGAGGACTGCCTGCAGGTGGAGAACTGCAC
 34  Q  L  G  E  Q  C  W  T  A  R  I  R  A  V  G  L  L  T  V  I
181 CCAGCTGGGGGAGCAGTGCTGGACCGCGCGCATCCGCGCAGTTGGCCTCCTGACCGTCAT
 54  S  K  G  C  S  L  N  C  V  D  D  S  Q  D  Y  Y  V  G  K  K
241 CAGCAAAGGCTGCAGCTTGAACTGCGTGGATGACTCACAGGACTACTACGTGGGCAAGAA
 74  N  I  T  C  C  D  T  D  L  C  N  A  S  G  A  H  A  L  Q  P
301 GAACATCACGTGCTGTGACACCGACTTGTGCAACGCCAGCGGGGCCCATGCCCTGCAGCC
 94  A  A  A  I  L  A  L  L  P  A  L  G  L  L  L  W  G  P  G  Q
361 GGCTGCCGCCATCCTTGCGCTGCTCCCTGCACTCGGCCTGCTGCTCTGGGGACCCGGCCA
114  L  *
421 GCTATAGgctctggggggccccgctgcagcccacactgggtgtggtgccccaggcctctg
481 tgccactcctcacacacccggcccagtgggagcctgtcctggttcctgaggcacatccta
541 acgcaagtctgaccatgtatgtctgcgccctgtccccaccctgaccctccatggccc
601 tctccaggactcccacccggcagatcggctctattgacacagatccgcctgcagatggcc
661 cctccaaccctctctgctgctgtttccatggcccagcattctccaccttaaccctgtgc
721 tcaggcacctcttcccccaggaagccttccctgcccacccatctatgacttgagccagg
781 tctggtccgtggtgtccccgcacccagcaggggacaggcactcaggagggcccggtaaa
841 ggctgagatgaagtggactgagtagaactggaggacaggagtcgacgtgagttcctggga
901 gtctccagagatggggcctggaggcctggaggaagggccaggcctcacattcgtggggc
961 tccctgaatggcagcctcagcacagcgtaggcccttaataaacacctgttggataagcca
```

Figure 2G. SNP variants of PSCA v.2, PSCA v.7 through v.18. The PSCA v.7 through v.18 proteins have 123 amino acids. Variants PSCA v.7 through v.18 are variants with single nucleotide difference from PSCA v.2, and code for the same protein as v.2. Though these SNP variants are shown separately, they can also occur in any combinations and in any of the transcript variants listed above in Figures 2A through 2F.

| Variant | Nucleic acid position | Nucleic Acid Variation | Amino Acid Variation |
|---|---|---|---|
| PSCA v.7 | 367 | C/T | Silent Variant |
| PSCA v.8 | 424 | A/C | Silent Variant |
| PSCA v.9 | 495 | C/G | Silent Variant |
| PSCA v.10 | 499 | C/T | Silent Variant |
| PSCA v.11 | 563 | C/T | Silent Variant |
| PSCA v.12 | 567 | G/A | Silent Variant |
| PSCA v.13 | 627 | G/A | Silent Variant |
| PSCA v.14 | 634 | T/G | Silent Variant |
| PSCA v.15 | 835 | G/A | Silent Variant |
| PSCA v.16 | 847 | G/A | Silent Variant |
| PSCA v.17 | 878 | G/A | Silent Variant |
| PSCA v.18 | 978 | C/G | Silent Variant |

Figure 2H. SNP variants of PSCA v.4, PSCA v.19 through v.30. The PSCA v.19 through v.30 proteins have 189 amino acids. Variants PSCA v.19 through v.30 are variants with single nucleotide difference from PSCA v.4. PSCA v.9, v.10, v.11, v.24 and v.25 proteins differ from PSCA v.1 by one amino acid. PSCA v.23, v.28, v.29 and v.30 code for the same protein as v.4. Though these SNP variants are shown separately, they can also occur in any combinations and in any of the transcript variants v.3 and v.4.

| Variant | Nucleic acid position | Nucleic Acid Variation | Amino Acid Position | Amino Acid Variation |
|---|---|---|---|---|
| PSCA v.19 | 521 | C/T | 33 | P/L |
| PSCA v.20 | 578 | A/C | 52 | Y/S |
| PSCA v.21 | 649 | C/G | 76 | H/D |
| PSCA v.22 | 653 | C/T | 77 | P/L |
| PSCA v.23 | 717 | C/T | 98 | *Silent variant* |
| PSCA v.24 | 721 | G/A | 100 | A/T |
| PSCA v.25 | 781 | G/A | 120 | G/S |
| PSCA v.26 | 788 | T/G | 122 | I/S |
| PSCA v.27 | 989 | G/A | 189 | R/Q |
| PSCA v.28 | 1001 | G/A | | *Silent Variant* |
| PSCA v.29 | 1032 | G/A | | *Silent Variant* |
| PSCA v.30 | 1132 | C/G | | *Silent Variant* |

Figure 3:

Figure 3A. Amino acid sequence of PSCA v.1 (SEQ ID. NO. :6532). The PSCA v.1 protein has 123 amino acids.

```
  1 MKAVLLALLM AGLALQPGTA LLCYSCKAQV SNEDCLQVEN CTQLGEQCWT ARIRAVGLLT
 61 VISKGCSLNC VDDSQDYYVG KKNITCCDTD LCNASGAHAL QPAAAILALL PALGLLLWGP
121 GQL
```

Figure 3B. Amino acid sequence of PSCA v.3 (SEQ ID. NO. :6536). The PSCA v.3 protein has 94 amino acids.

```
  1 MYVCAPVPHP DPPMALSRTP TRQIGSIDTD PPADGPSNPL CCCFHGPAFS TLNPVLRHLF
 61 PQEAFPAHPI YDLSQVWSVV SPAPSRGQAL RRAR
```

Figure 3C. Amino acid sequence of PSCA v.4 (SEQ ID. NO. :6540). The PSCA v.4 protein has 189 amino acids.

```
  1 MTHRTTTWAR RTSRAVIPTC ATPAGPMPCS RLPPSLRCSL HSACCSGDPA SYRLWGAPLQ
 61 PTLGVVPQAS VPLLTHPAQW EPVLVPEAHP NASLTMYVCA PVPHPDPPMA LSRTPTRQIG
121 SIDTDPPADG PSNPLCCCFH GPAFSTLNPV LRHLFPQEAF PAHPIYDLSQ VWSVVSPAPS
181 RGQALRRAR
```

Figure 3D. Amino acid sequence of PSCA v.6 (SEQ ID. NO. :6546). The PSCA v.6 protein has 114 amino acids.

```
  1 MAGLALQPGT ALLCYSCKAQ VSNEDCLQVE NCTQLGEQCW TARIRAVGLL TVISKGCSLN
 61 CVDDSQDYYV GKKNITCCDT DLCNASGAHA LQPAAAILAL LPALGLLLWG PGQL
```

Figure 3E. Amino acid sequence of PSCA v.19 (SEQ ID. NO. :6547). The PSCA v.19 protein has 189 amino acids.

```
  1 MTHRTTTWAR RTSRAVIPTC ATPAGPMPCS RLLPSLRCSL HSACCSGDPA SYRLWGAPLQ
 61 PTLGVVPQAS VPLLTHPAQW EPVLVPEAHP NASLTMYVCA PVPHPDPPMA LSRTPTRQIG
121 SIDTDPPADG PSNPLCCCFH GPAFSTLNPV LRHLFPQEAF PAHPIYDLSQ VWSVVSPAPS
181 RGQALRRAR
```

Figure 3F. Amino acid sequence of PSCA v.20 (SEQ ID. NO. :6548). The PSCA v.20 protein has 189 amino acids.

```
  1 MTHRTTTWAR RTSRAVIPTC ATPAGPMPCS RLPPSLRCSL HSACCSGDPA SSRLWGAPLQ
 61 PTLGVVPQAS VPLLTHPAQW EPVLVPEAHP NASLTMYVCA PVPHPDPPMA LSRTPTRQIG
121 SIDTDPPADG PSNPLCCCFH GPAFSTLNPV LRHLFPQEAF PAHPIYDLSQ VWSVVSPAPS
181 RGQALRRAR
```

Figure 3G. Amino acid sequence of PSCA v.21 (SEQ ID. NO. :6549). The PSCA v.21 protein has 189 amino acids.

```
  1 MTHRTTTWAR RTSRAVIPTC ATPAGPMPCS RLPPSLRCSL HSACCSGDPA SYRLWGAPLQ
 61 PTLGVVPQAS VPLLTDPAQW EPVLVPEAHP NASLTMYVCA PVPHPDPPMA LSRTPTRQIG
121 SIDTDPPADG PSNPLCCCFH GPAFSTLNPV LRHLFPQEAF PAHPIYDLSQ VWSVVSPAPS
181 RGQALRRAR
```

Figure 3H. Amino acid sequence of PSCA v.22 (SEQ ID. NO. :6550). The PSCA v.22 protein has 189 amino acids.

```
  1 MTHRTTTWAR RTSRAVTPTC ATPAGPMPCS RLPPSLRCSL HSACCSGDPA SYRLWGAPLQ
 61 PTLGVVPQAS VPLLTHLAQW EPVLVPEAHP NASLTMYVCA PVPHPDPPMA LSRTPTRQIG
121 SIDTDPPADG PSNPLCCCFH GPAFSTLNPV LRHLFPQEAF PAHPIYDLSQ VWSVVSPAPS
181 RGQALRRAR
```

Figure 3I. Amino acid sequence of PSCA v.24 (SEQ ID. NO. :6551). The PSCA v.24 protein has 189 amino acids.

```
  1 MTHRTTTWAR RTSRAVTPTC ATPAGPMPCS RLPPSLRCSL HSACCSGDPA SYRLWGAPLQ
 61 PTLGVVPQAS VPLLTHPAQW EPVLVPEAHP NASLTMYVCT PVPHPDPPMA LSRTPTRQIG
121 SIDTDPPADG PSNPLCCCFH GPAFSTLNPV LRHLFPQEAF PAHPIYDLSQ VWSVVSPAPS
181 RGQALRRAR
```

Figure 3J. Amino acid sequence of PSCA v.25 (SEQ ID. NO. :6552). The PSCA v.25 protein has 189 amino acids.

```
  1 MTHRTTTWAR RTSRAVTPTC ATPAGPMPCS RLPPSLRCSL HSACCSGDPA SYRLWGAPLQ
 61 PTLGVVPQAS VPLLTHPAQW EPVLVPEAHP NASLTMYVCA PVPHPDPPMA LSRTPTRQIS
121 SIDTDPPADG PSNPLCCCFH GPAFSTLNPV LRHLFPQEAF PAHPIYDLSQ VWSVVSPAPS
181 RGQALRRAR
```

Figure 3K. Amino acid sequence of PSCA v.26 (SEQ ID. NO. :6553). The PSCA v.26 protein has 189 amino acids.

```
  1 MTHRTTTWAR RTSRAVTPTC ATPAGPMPCS RLPPSLRCSL HSACCSGDPA SYRLWGAPLQ
 61 PTLGVVPQAS VPLLTHPAQW EPVLVPEAHP NASLTMYVCA PVPHPDPPMA LSRTPTRQIG
121 SSDTDPPADG PSNPLCCCFH GPAFSTLNPV LRHLFPQEAF PAHPIYDLSQ VWSVVSPAPS
181 RGQALRRAR
```

Figure 3L. Amino acid sequence of PSCA v.27 (SEQ ID. NO. :6554). The PSCA v.27 protein has 189 amino acids.

```
  1 MTHRTTTWAR RTSRAVTPTC ATPAGPMPCS RLPPSLRCSL HSACCSGDPA SYRLWGAPLQ
 61 PTLGVVPQAS VPLLTHPAQW EPVLVPEAHP NASLTMYVCA PVPHPDPPMA LSRTPTRQIG
121 SIDTDPPADG PSNPLCCCFH GPAFSTLNPV LRHLFPQEAF PAHPIYDLSQ VWSVVSPAPS
181 RGQALRRAQ
```

Figure 4: Alignment of PSCA v.4 (SEQ ID NO:6540) with known homologs

Alignment with human Prostate Stem Cell Antigen (gi 27482160) (SEQ ID NO:6556)

Score = 277 bits (708), Expect = 8e-74
Identities = 187/189 (98%), Positives = 187/189 (98%)

```
Query: 1    MTHRTTTWARRTSRAVTPTCATPAGPMPCSRLPPSLRCSLHSACCSGDPASYRLWGAPLQ 60
            MTHRTTTWARRTSRAVTPTCATPAGPMPCSRL PSLRCSLHSACCSGDPAS RLWGAPLQ
Sbjct: 1    MTHRTTTWARRTSRAVTPTCATPAGPMPCSRLLPSLRCSLHSACCSGDPASSRLWGAPLQ 60

Query: 61   PTLGVVPQASVPLLTHPAQWEPVLVPEAHPNASLTMYVCAPVPHPDPPMALSRTPTRQIG 120
            PTLGVVPQASVPLLTHPAQWEPVLVPEAHPNASLTMYVCAPVPHPDPPMALSRTPTRQIG
Sbjct: 61   PTLGVVPQASVPLLTHPAQWEPVLVPEAHPNASLTMYVCAPVPHPDPPMALSRTPTRQIG 120

Query: 121  SIDTDPPADGPSNPLCCCFEGPAFSTLNPVLRHLFPQEAFPAHPIYDLSQVWSVVSPAPS 180
            SIDTDPPADGPSNPLCCCFEGPAFSTLNPVLRHLFPQEAFPAHPIYDLSQVWSVVSPAPS
Sbjct: 121  SIDTDPPADGPSNPLCCCFEGPAFSTLNPVLRHLFPQEAFPAHPIYDLSQVWSVVSPAPS 180

Query: 181  RGQALRRAR 189
            RGQALRRAR
Sbjct: 181  RGQALRRAR 189
```

Figure 5a PSCA variant 1 Hydrophilicity profile
(Hopp T.P., Woods K.R., 1981.
Proc. Natl. Acad. Sci. U.S.A. 78:3824-3828)
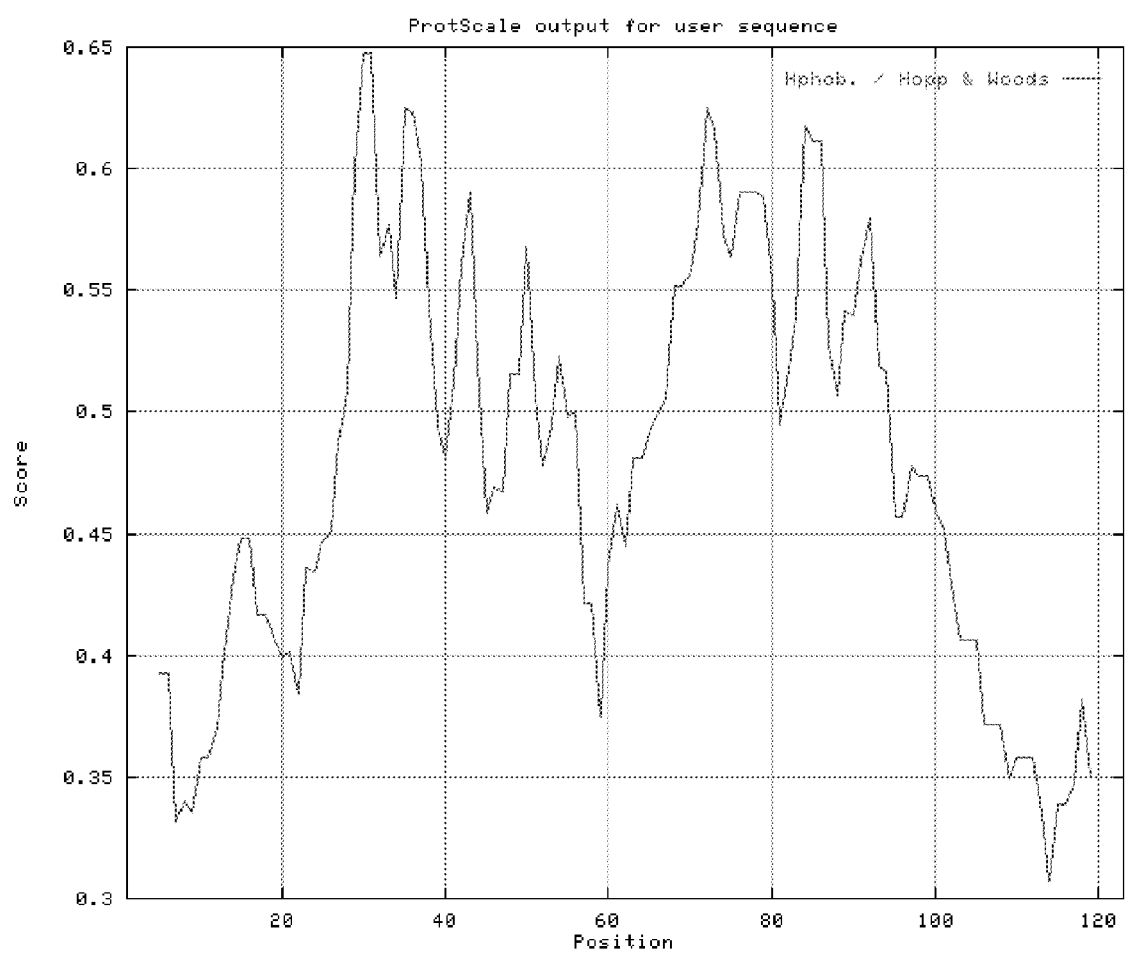

Figure 5b PSCA variant 3 Hydrophilicity profile
(Hopp T.P., Woods K.R., 1981. Proc. Natl.
Acad. Sci. U.S.A. 78:3824-3828)
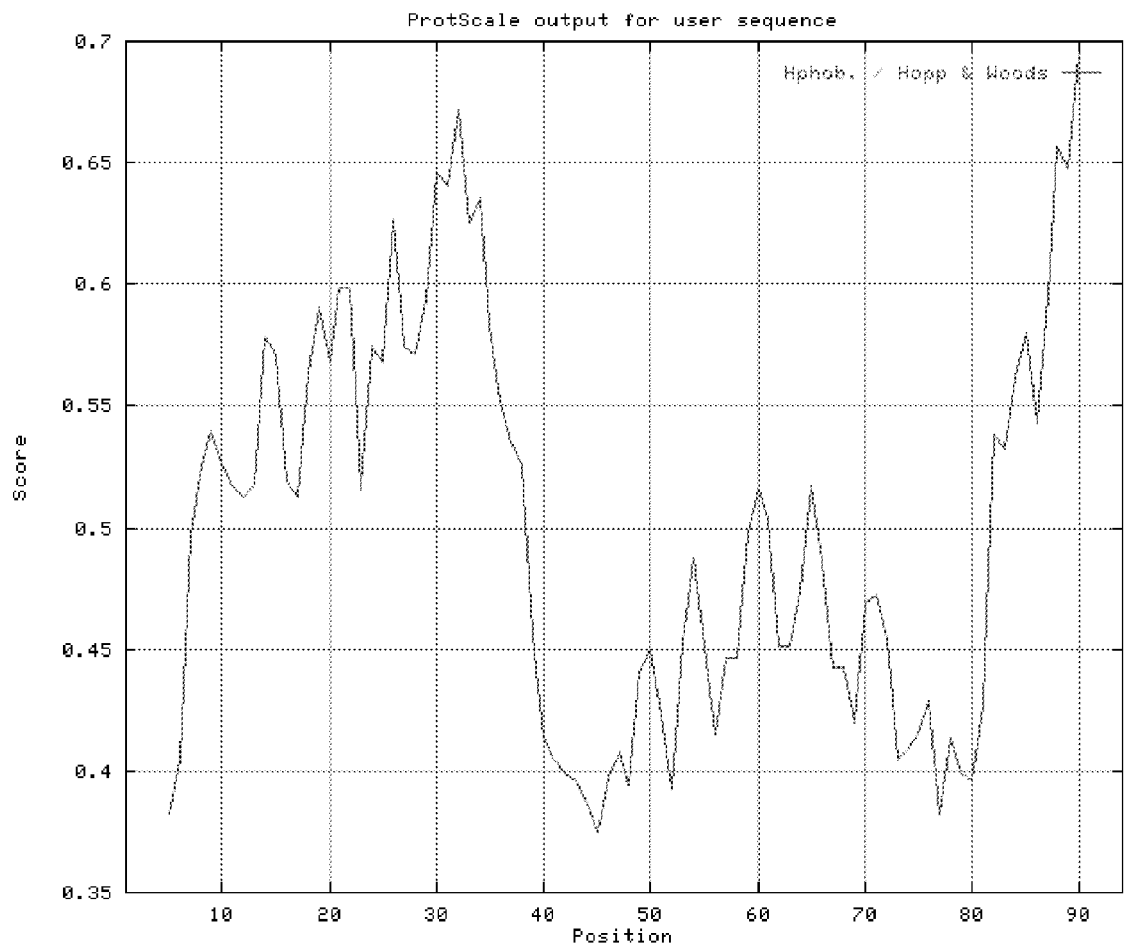

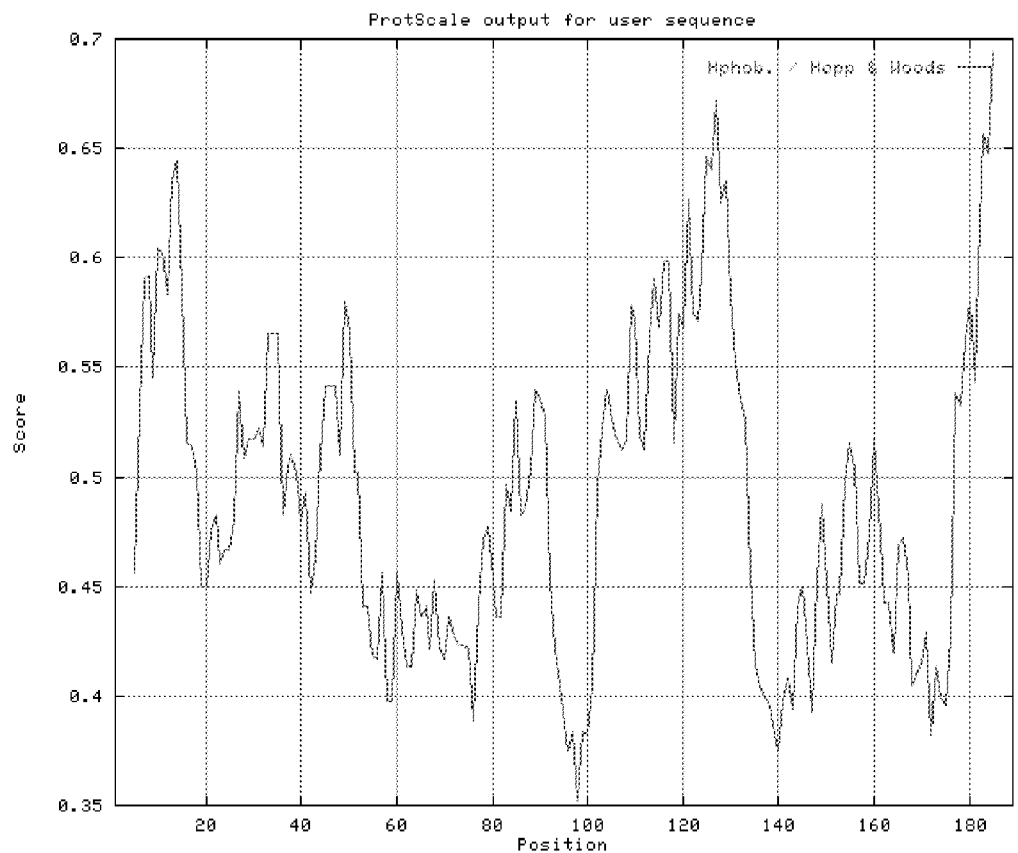
Figure 5c PSCA variant 4
Hydrophilicity profile
(Hopp T.P., Woods K.R., 1981. Proc. Natl. Acad. Sci. U.S.A. 78:3824-3828)

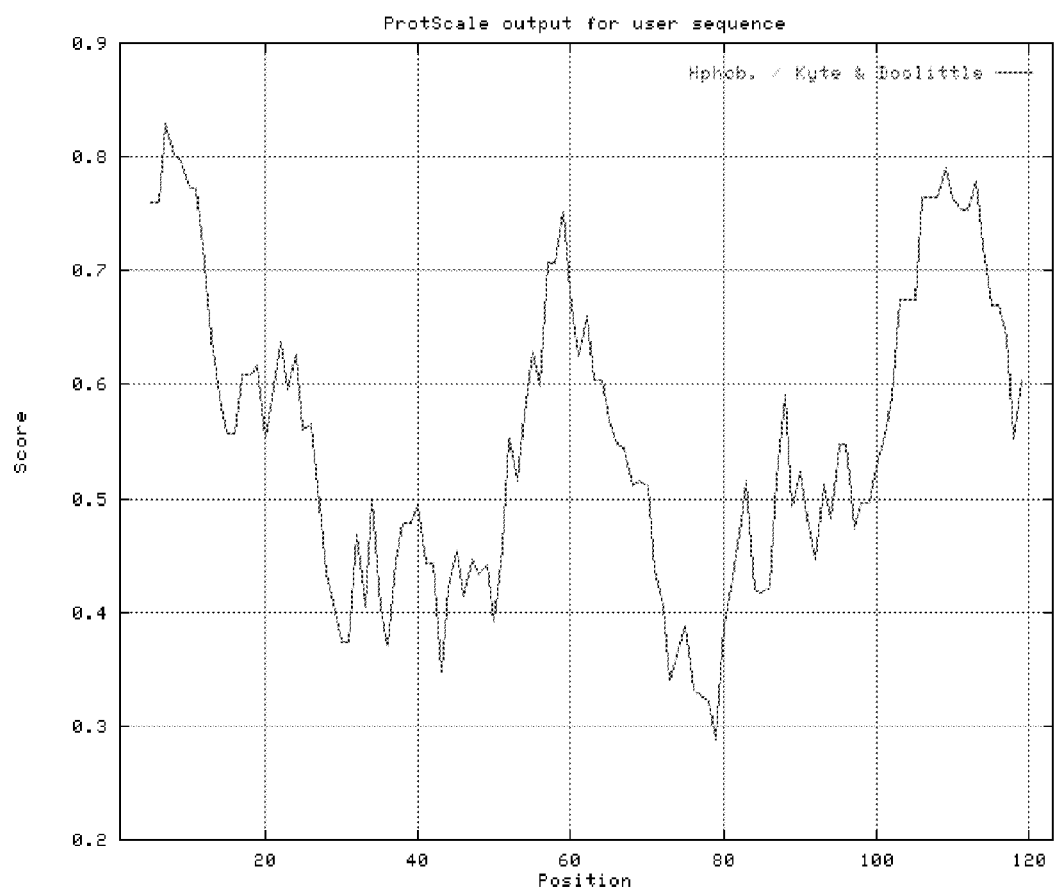
Figure 6a PSCA variant 1
Hydropathicity Profile
(Kyte J., Doolittle R.F., 1982. J. Mol. Biol. 157:105-132)

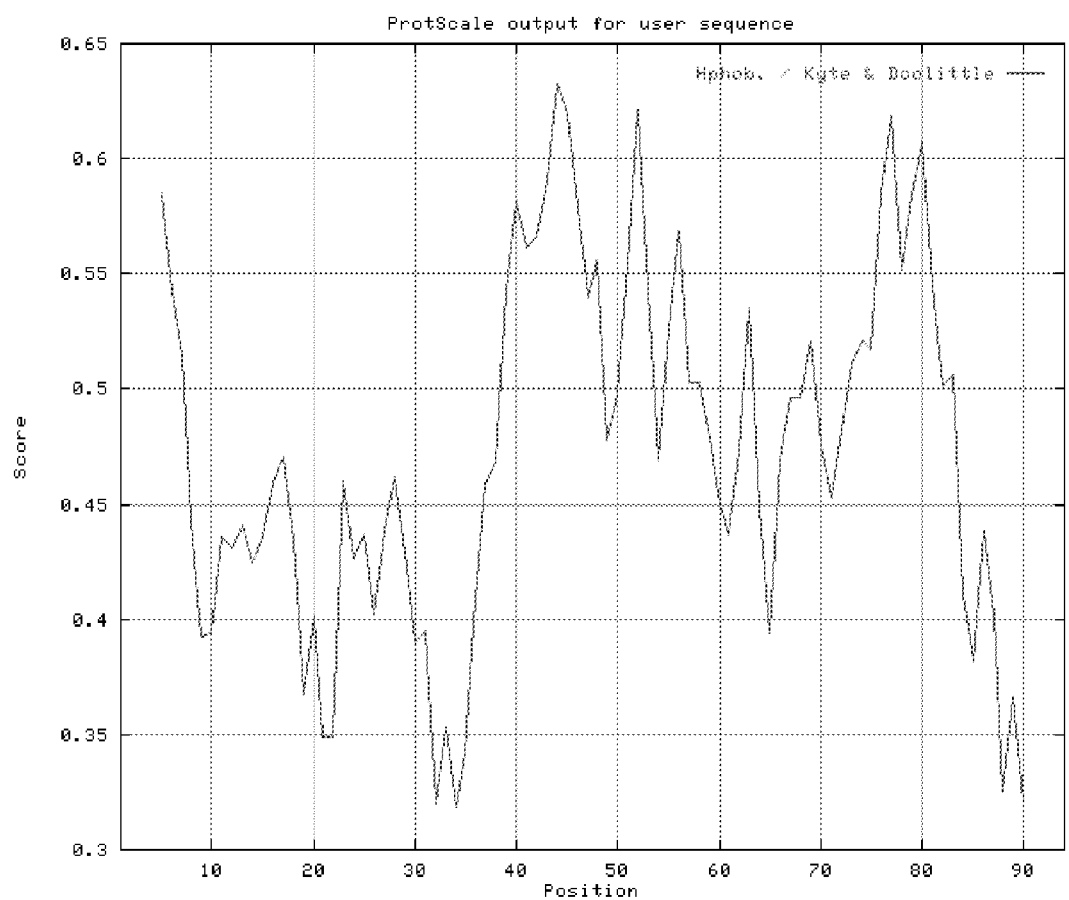
Figure 6b PSCA variant 3 Hydropathicity Profile
(Kyte J., Doolittle R.F., 1982. J. Mol. Biol. 157:105-132)

Figure 6c PSCA variant 4 Hydropathicity Profile
(Kyte J., Doolittle R.F., 1982. J. Mol. Biol. 157:105-132)
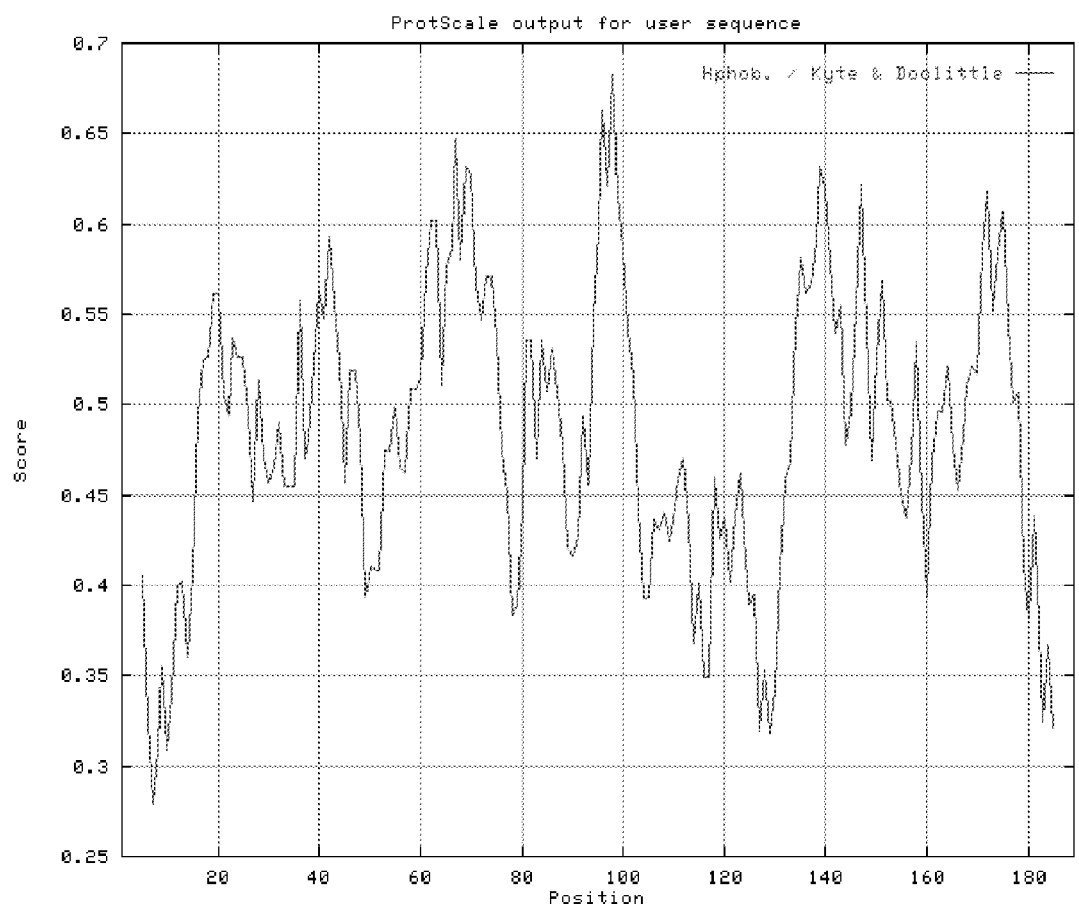

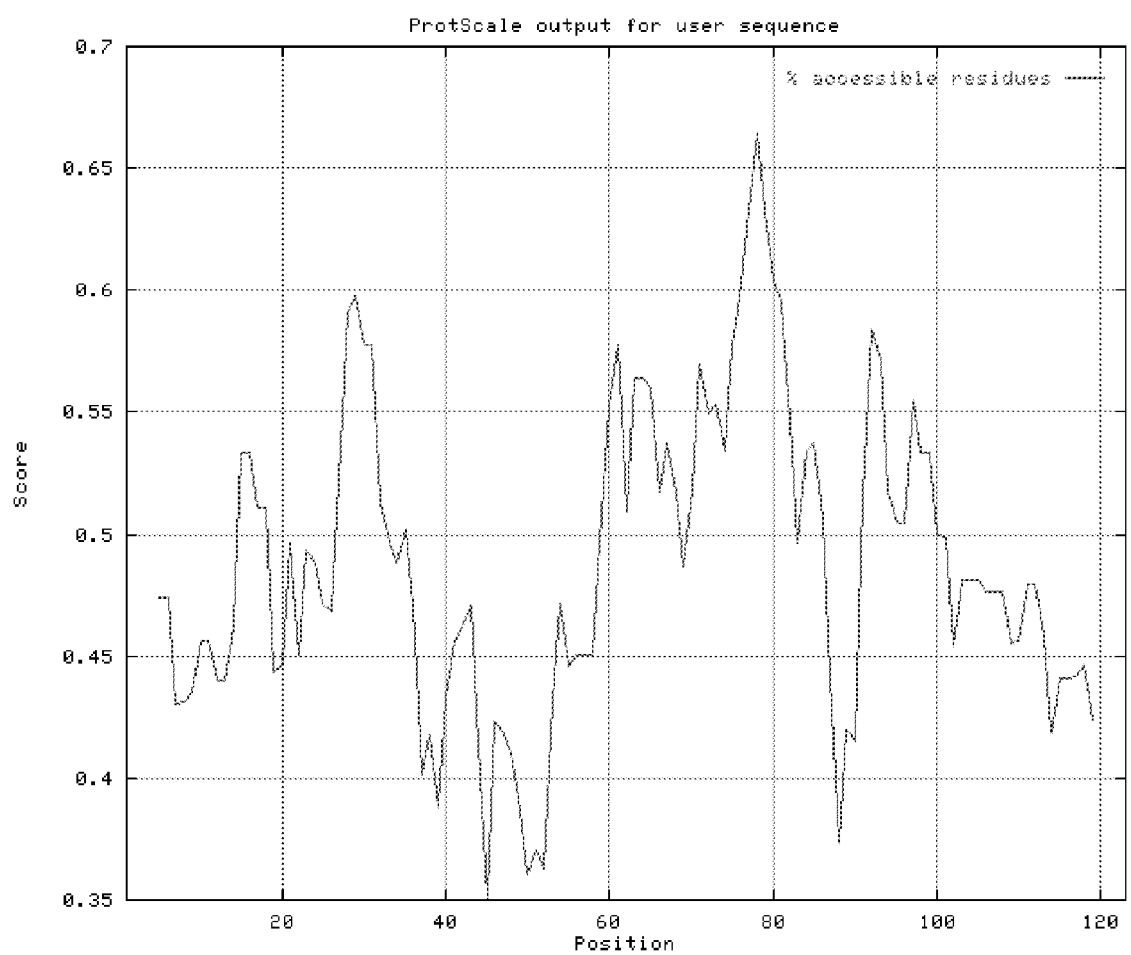
Figure 7a PSCA variant 1 % Accessible Residues Profile
(Janin J., 1979. Nature 277:491-492)

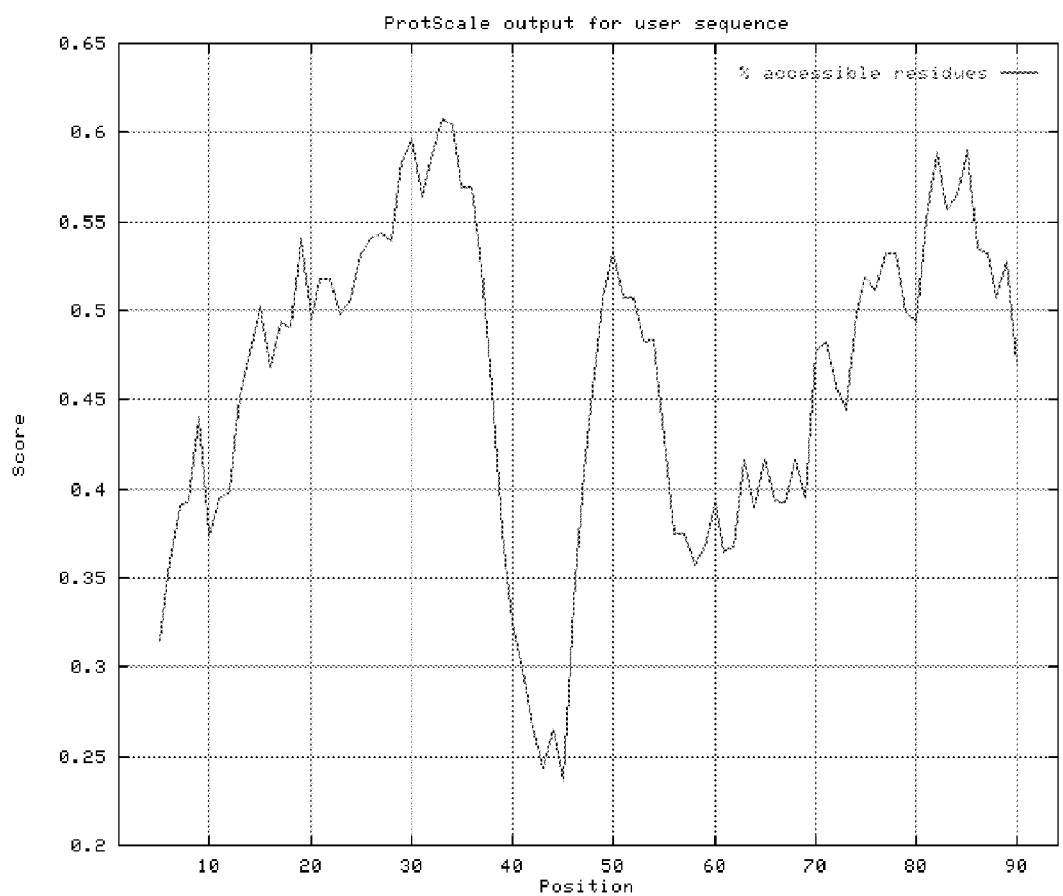
Figure 7b PSCA variant 3
% Accessible Residues Profile
(Janin J., 1979. Nature 277:491-492)

Figure 7c PSCA variant 4 %
Accessible Residues Profile
(Janin J., 1979. Nature 277:491-492)
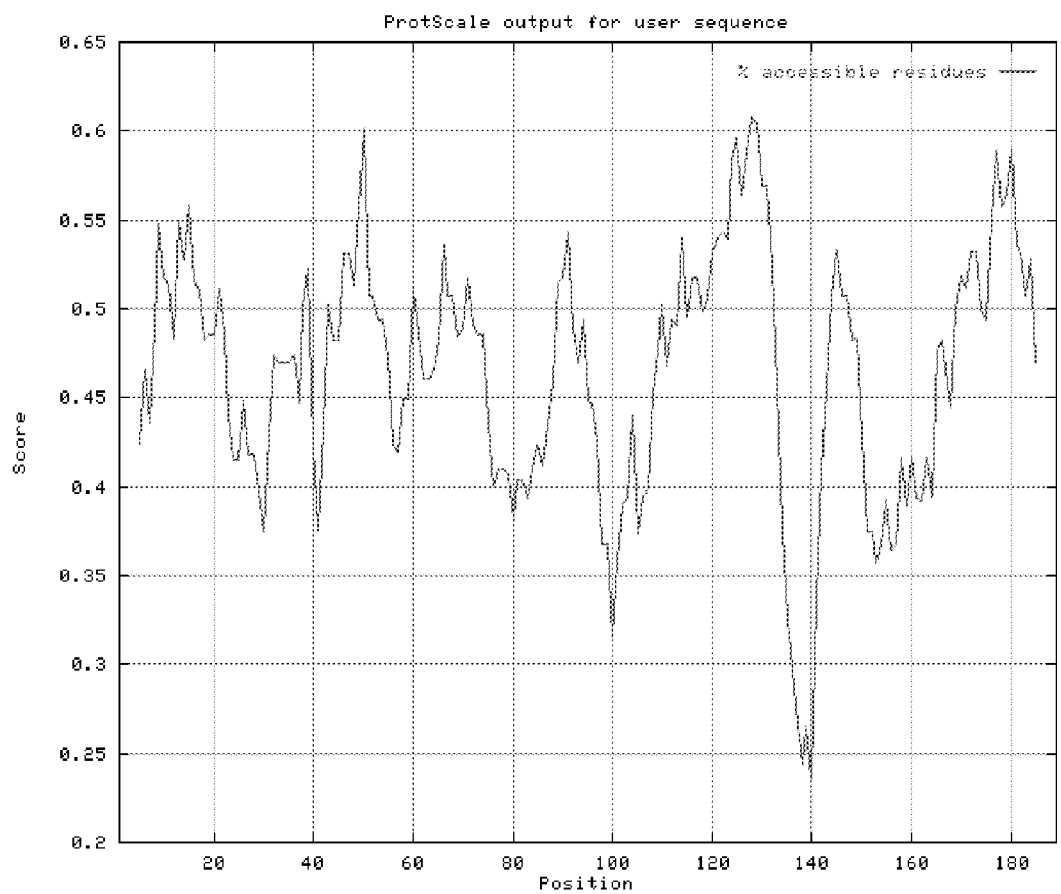

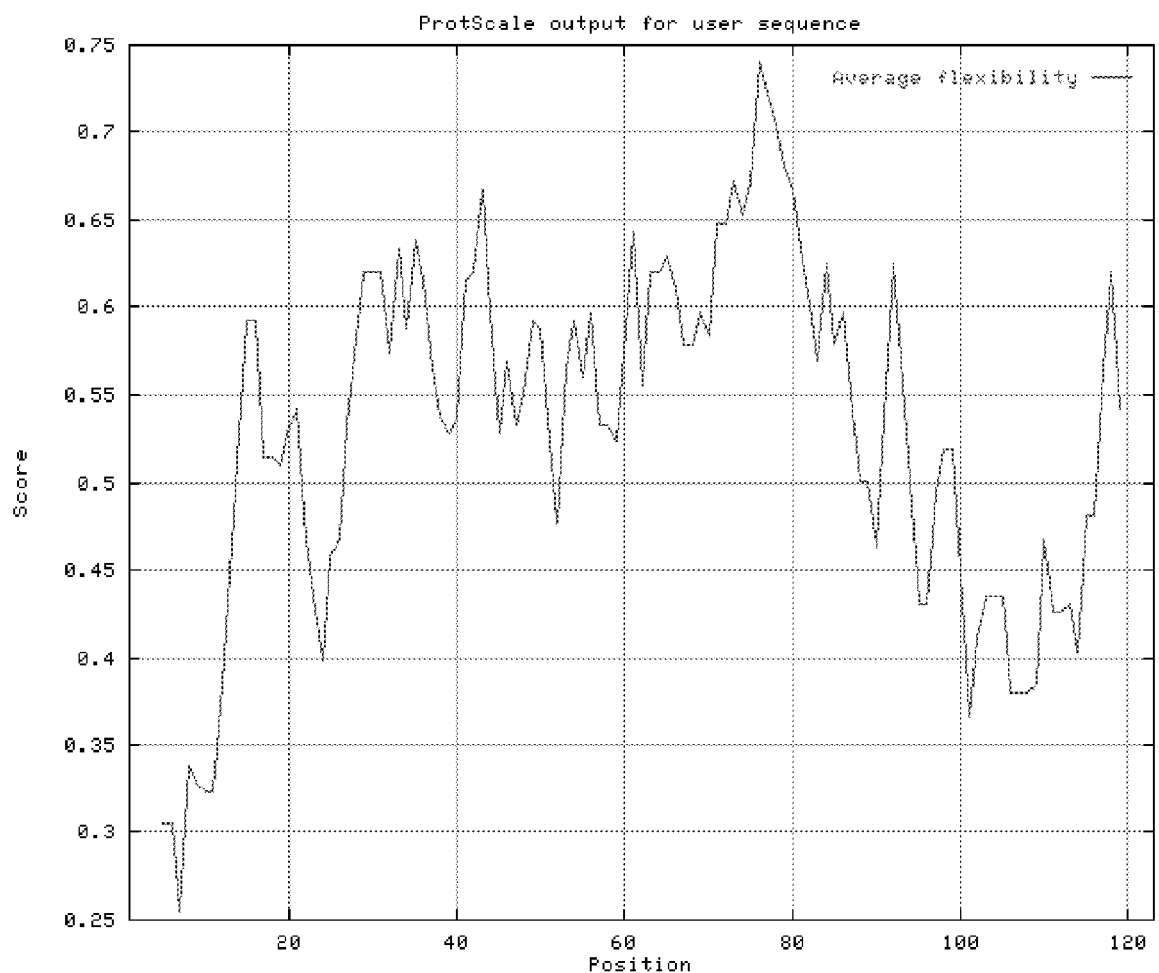
Figure 8a PSCA variant 1
Average Flexibility Profile
(Bhaskaran R., Ponnuswamy P.K., 1988.
Int. J. Pept. Protein Res. 32:242-255)

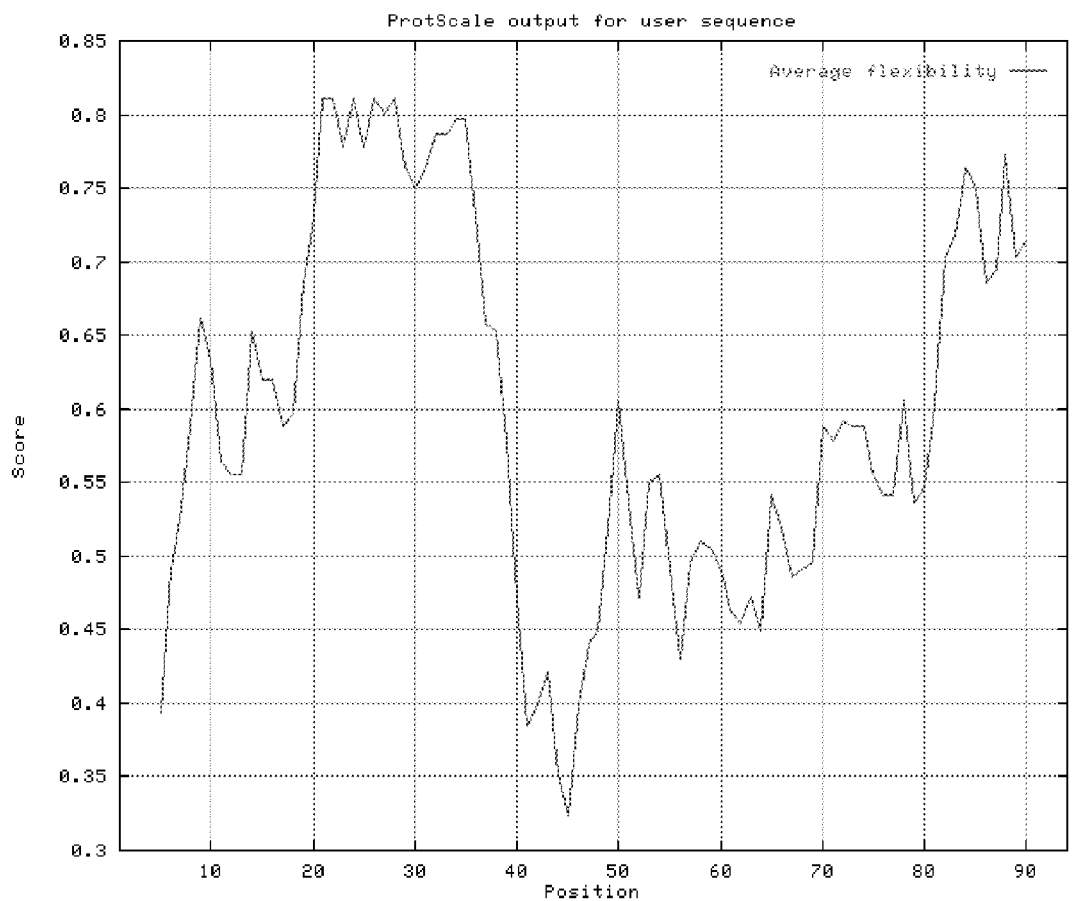
Figure 8b PSCA variant 3
Average Flexibility Profile
(Bhaskaran R., Ponnuswamy P.K., 1988.
Int. J. Pept. Protein Res. 32:242-255)

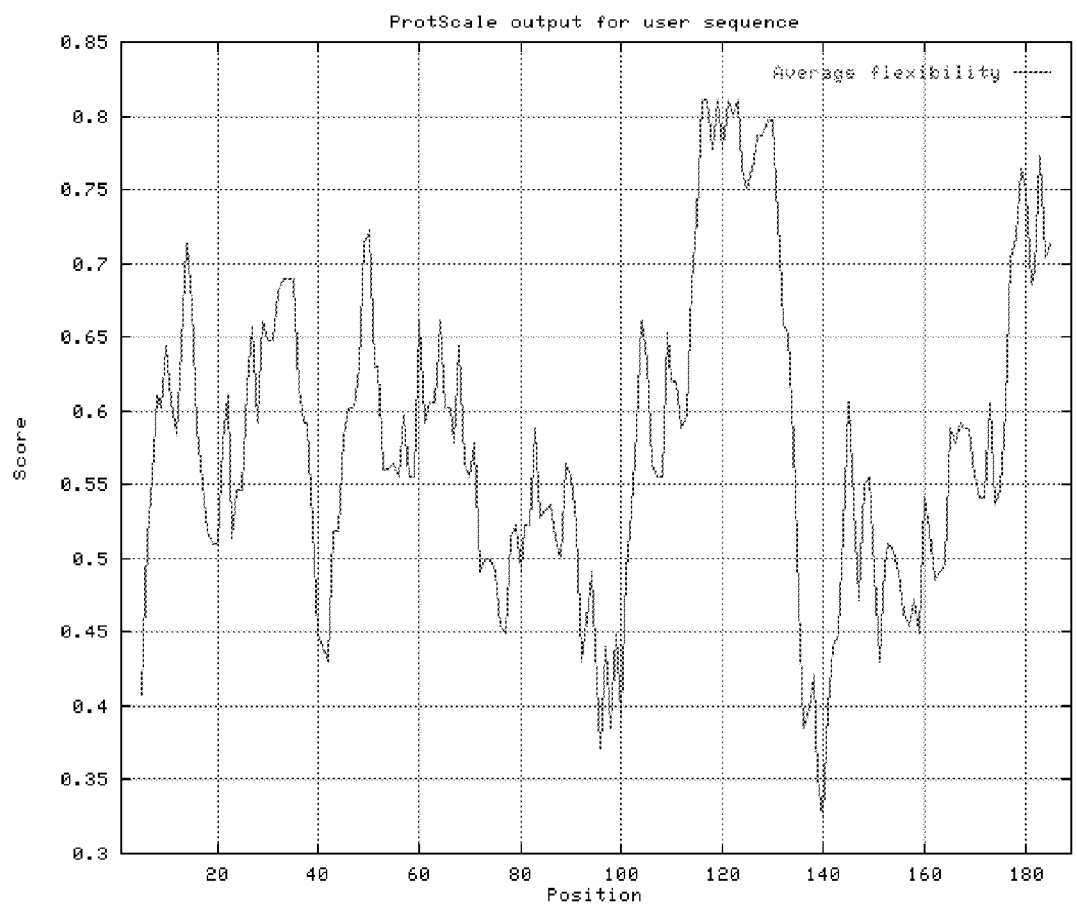
Figure 8c PSCA variant 4
Average Flexibility Profile
(Bhaskaran R., Ponnuswamy P.K., 1988.
Int. J. Pept. Protein Res. 32:242-255)

Figure 9a PSCA variant 1
Beta-turn Profile
(Deleage, G., Roux B. 1987. Protein Engineering 1:289-294)
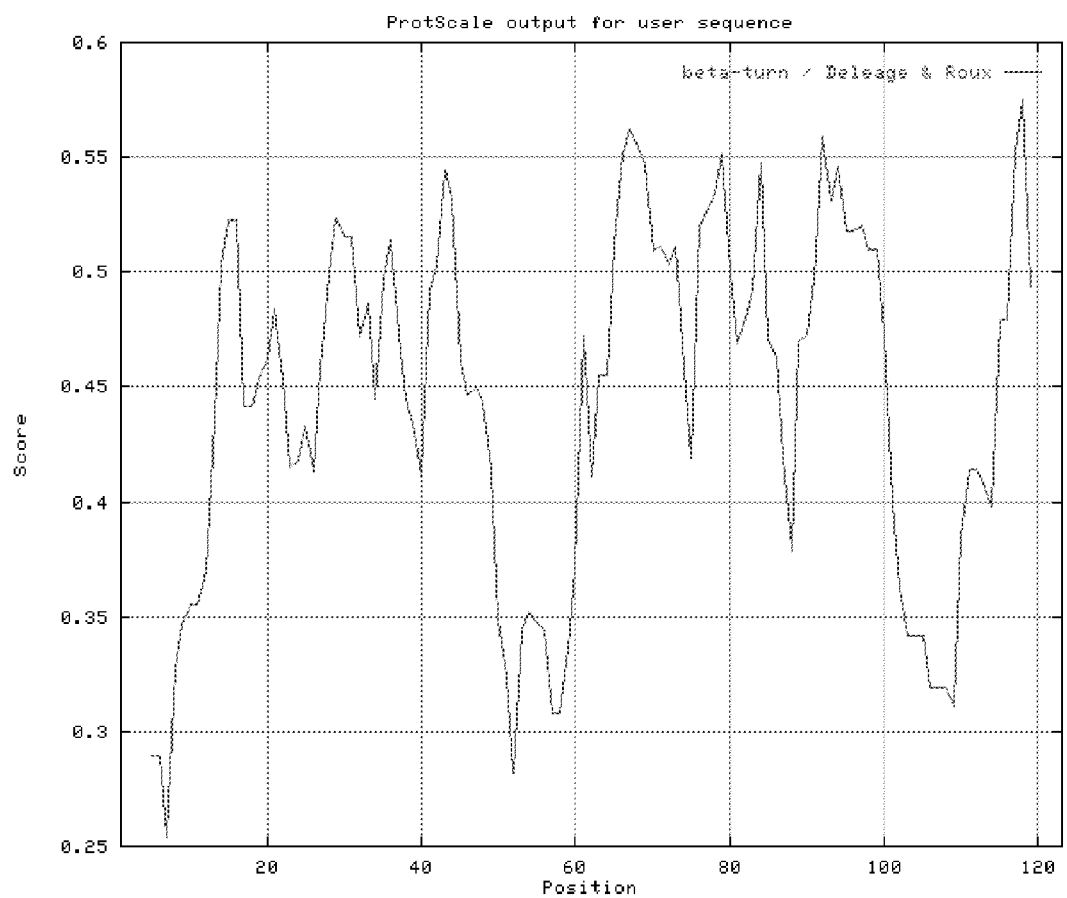

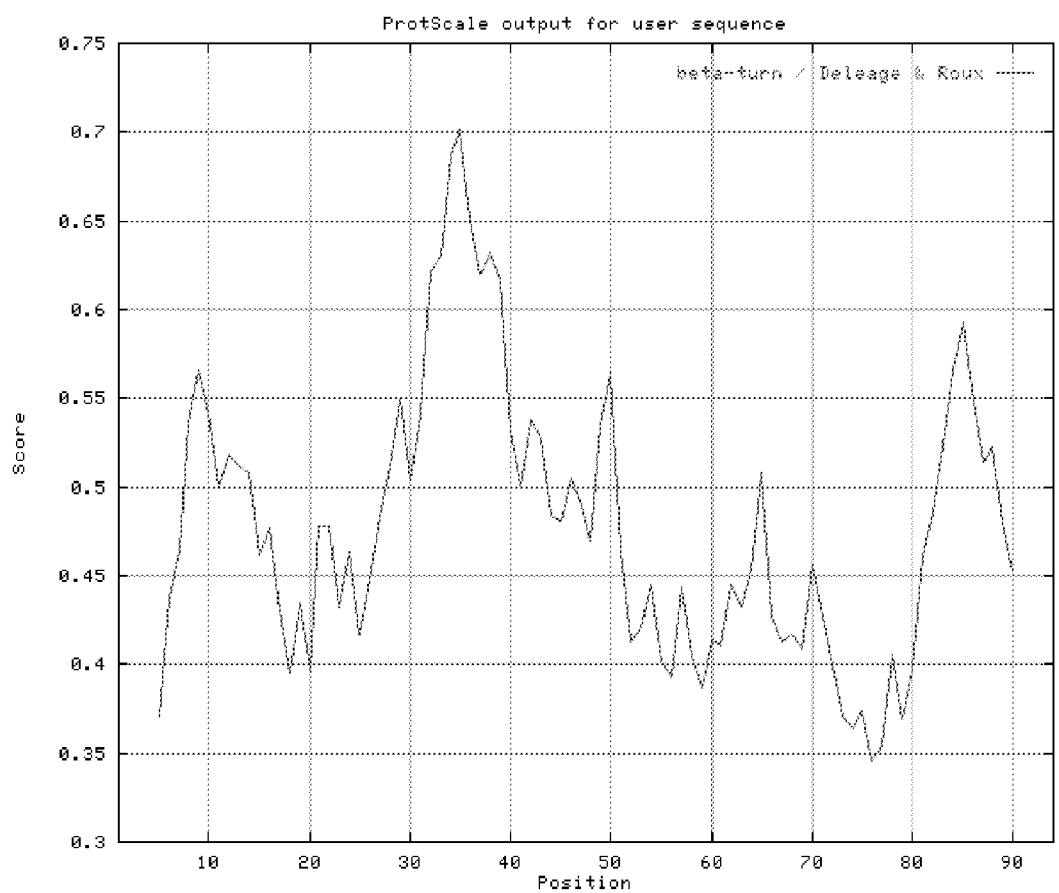
Figure 9b PSCA variant 3 Beta-turn Profile
(Deleage, G., Roux B. 1987. Protein Engineering 1:289-294)

Figure 9c PSCA variant 4
Beta-turn Profile
(Deleage, G., Roux B. 1987. Protein Engineering 1:289-294)
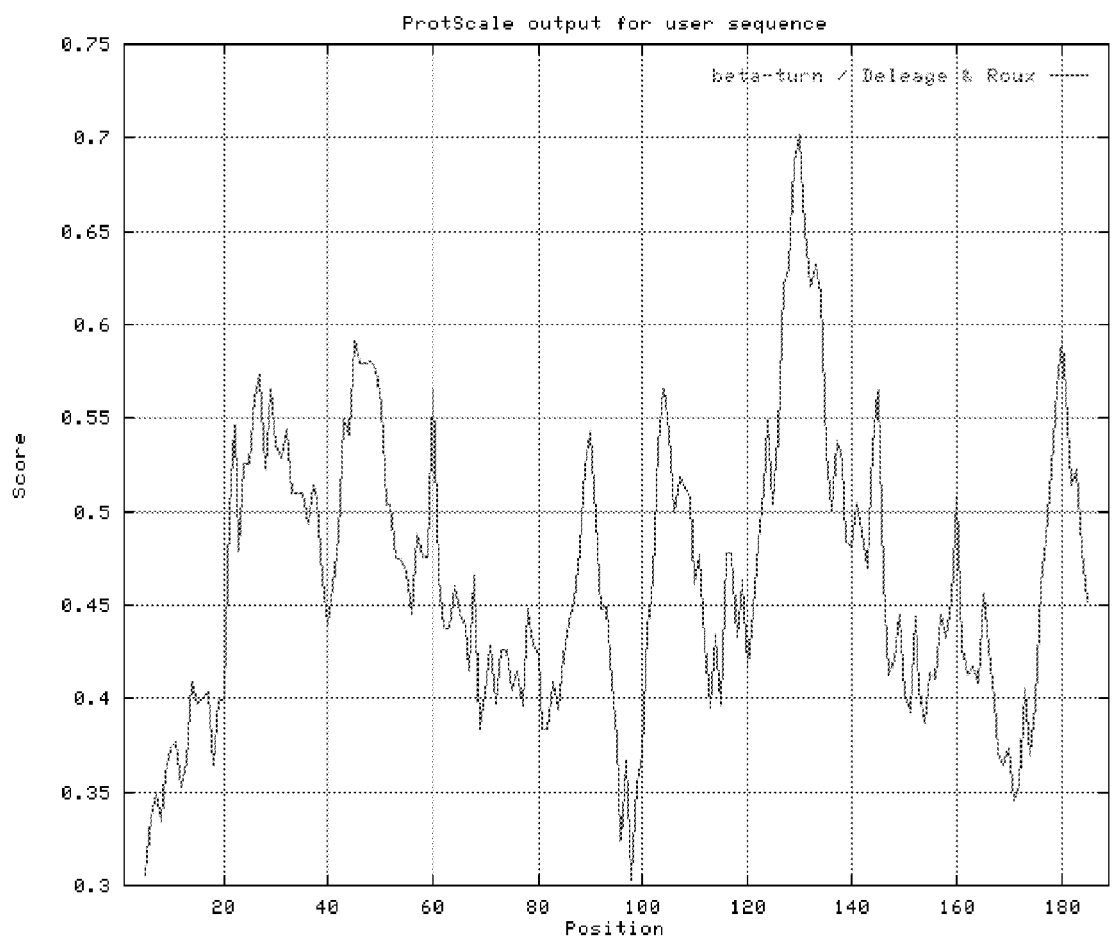

Figure 13A

Secondary structure prediction of PSCA variant 1

```
         10        20        30        40        50        60        70
          |         |         |         |         |         |         |
MKAVLLALLMAGLALQPGTALLCYSCKAQVSNEDCLQVENCTQLGEQCWTARIRAVGLLTVISKGCSLNC
cchhhhhhhhhhcccceeeeeecccccccceeeeecccccccchhhhhhheecceeeeeecccccccc
VDDSQDYYVGKKNITCCDTDLCNASGAHALQPAAAILALLPALGLLLWGPGQL
cccccccceeccceeeeeccccccccccccchhhhhhhhhhhhchheeeeccccc
```

Alpha helix (h): 30.89%
Extended strand (e): 21.95%
Random coil (c): 47.15%

Figure 13B

Secondary structure prediction of PSCA variant 3

```
         10        20        30        40        50        60        70
          |         |         |         |         |         |         |
MYVCAPVPHPDPPMALSRTPTRQIGSIDTDPPADGPSNPLCCCFHGPAFSTLNPVLRHLFPQEAFPAHPI
ceecccccccccccccccccccccccccccccccccccccccchhhhhhhhcccccccccccc YDLSQVWSVVSPAPSRGQALRRAR
cccceeeecccccccchhhhhcc
```

Alpha helix (h): 14.89%
Extended strand (e): 8.51%
Random coil (c): 76.60%

Figure 13C

Secondary structure prediction of PSCA variant 4

```
         10        20        30        40        50        60        70
          |         |         |         |         |         |         |
MTHRTTTWARRTSRAVTPTCATPAGPMPCSRLPPSLRCSLHSACCSGDPASYRLWGAPLQPTLGVVPQAS
ccccccchhhccchccccccccccccccccccccccccccccccccccccccccccccccccccccc
VPLLTHPAQWEPVLVPEAHPNASLTMYVCAPVPHPDPPMALSRTPTRQIGSIDTDPPADGPSNPLCCCFH
ccccccccccccccccccccccceeeecccccccccccccccccccccccccccccccccccccccc
GPAFSTLNPVLRHLFPQEAFPAHPIYDLSQVWSVVSPAPSRGQALRRAR
ccchhhhhhhhcccccccccceeeeeeccccccchhhhcc
```

Alpha helix (h): 9.52%
Extended strand (e): 8.99%
Random coil (c) : 81.48%

Figure 13D

Secondary structure prediction of PSCA variant 6

```
         10        20        30        40        50        60        70
         |         |         |         |         |         |         |
MAGLALQPGTALLCYSCKAQVSNEDCLQVENCTQLGEQCWTARIRAVGLLTVISKGCSLNCVDDSQDYYV
ccccecccchhhhcccccccccccccceeecccccccchhhhhhhheecceeeeecccccccccccccee
GKKNITCCDTDLCNASGAHALQPAAAILALLPALGLLLWGPGQL
ccceeeeccccccccchhhhhhhhhhhhchheeeccccc
```

Alpha helix (h): 24.56%
Extended strand (e): 21.93%
Random coil (c): 53.51%

2 transmembrane domains
predicted encode
a cleavable C-terminal
GPI anchor and N-terminal
signal sequence Transmembrane domains No transmembrane domain
predicted No transmembrane domain predicted No transmembrane domain predicted No transmembrane domain predicted No transmembrane domain predicted 1 transmembrane domain predicted No transmembrane domain predicted

PROSTATE STEM CELL ANTIGEN (PSCA) VARIANTS AND SUBSEQUENCES THEREOF

CROSS-REFERENCE TO RELATED APPLICATIONS

This application claims benefit of U.S. provisional application 60/475,064 filed 30 May 2003. The contents of this document are incorporated herein by reference.

REFERENCE TO SEQUENCE LISTING SUBMITTED VIA EFS-WEB

The entire content of the following electronic submission of the sequence listing via the USPTO EFS-WEB server, as authorized and set forth in MPEP §1730 II.B.2(a)(C), is incorporated herein by reference in its entirety for all purposes. The sequence listing is identified on the electronically filed text file as follows:

| File Name | Date of Creation | Size (bytes) |
|---|---|---|
| 511582008800seqlist.txt | May 26, 2004 | 1,043,164 bytes |

SUBMISSION ON COMPACT DISC

The content of the following submission on compact discs is incorporated herein by reference in its entirety: A compact disc copy of the Sequence Listing (COPY 1) (file name: 511582008800, date recorded: May 27, 2004, size: 1,044,480 bytes); and a duplicate compact disc copy of the Sequence Listing (COPY 2) (file name: 511582008800, date recorded: May 27, 2004, size: 1,044,480 bytes).

TECHNICAL FIELD

The invention described herein relates to genes and their encoded proteins, termed PSCA, expressed in certain cancers, and to diagnostic and therapeutic methods and compositions useful in the management of cancers that express PSCA.

BACKGROUND ART

Cancer is the second leading cause of human death next to coronary disease. Worldwide, millions of people die from cancer every year. In the United States alone, as reported by the American Cancer Society, cancer causes the death of well over a half-million people annually, with over 1.2 million new cases diagnosed per year. While deaths from heart disease have been declining significantly, those resulting from cancer generally are on the rise. In the early part of the next century, cancer is predicted to become the leading cause of death.

Worldwide, several cancers stand out as the leading killers. In particular, carcinomas of the lung, prostate, breast, colon, pancreas, and ovary represent the primary causes of cancer death. These and virtually all other carcinomas share a common lethal feature. With very few exceptions, metastatic disease from a carcinoma is fatal. Moreover, even for those cancer patients who initially survive their primary cancers, common experience has shown that their lives are dramatically altered. Many cancer patients experience strong anxieties driven by the awareness of the potential for recurrence or treatment failure. Many cancer patients experience physical debilitations following treatment. Furthermore, many cancer patients experience a recurrence.

Worldwide, prostate cancer is the fourth most prevalent cancer in men. In North America and Northern Europe, it is by far the most common cancer in males and is the second leading cause of cancer death in men. In the United States alone, well over 30,000 men die annually of this disease—second only to lung cancer. Despite the magnitude of these figures, there is still no effective treatment for metastatic prostate cancer. Surgical prostatectomy, radiation therapy, hormone ablation therapy, surgical castration and chemotherapy continue to be the main treatment modalities. Unfortunately, these treatments are ineffective for many and are often associated with undesirable consequences.

On the diagnostic front, the lack of a prostate tumor marker that can accurately detect early-stage, localized tumors remains a significant limitation in the diagnosis and management of this disease. Although the serum prostate specific antigen (PSA) assay has been a very useful tool, however its specificity and general utility is widely regarded as lacking in several important respects.

Progress in identifying additional specific markers for prostate cancer has been improved by the generation of prostate cancer xenografts that can recapitulate different stages of the disease in mice. The LAPC (Los Angeles Prostate Cancer) xenografts are prostate cancer xenografts that have survived passage in severe combined immune deficient (SCID) mice and have exhibited the capacity to mimic the transition from androgen dependence to androgen independence (Klein et al., 1997, Nat. Med. 3:402). More recently identified prostate cancer markers include PCTA-1 (Su et al., 1996, Proc. Natl. Acad. Sci. USA 93: 7252), prostate-specific membrane (PSM) antigen (Pinto et al., Clin Cancer Res 1996 Sep. 2 (9): 1445-51), STEAP (Hubert, et at., Proc Natl Acad Sci USA. 1999 Dec. 7; 96(25): 14523-8) and prostate stem cell antigen (PSCA) (Reiter et al., 1998, Proc. Natl. Acad. Sci. USA 95: 1735).

While previously identified markers such as PSA, PSM, PCTA and PSCA have facilitated efforts to diagnose and treat prostate cancer, there is need for the identification of additional markers and therapeutic targets for prostate and related cancers in order to further improve diagnosis and therapy.

Renal cell carcinoma (RCC) accounts for approximately 3 percent of adult malignancies. Once adenomas reach a diameter of 2 to 3 cm, malignant potential exists. In the adult, the two principal malignant renal tumors are renal cell adenocarcinoma and transitional cell carcinoma of the renal pelvis or ureter. The incidence of renal cell adenocarcinoma is estimated at more than 29,000 cases in the United States, and more than 11,600 patients died of this disease in 1998. Transitional cell carcinoma is less frequent, with an incidence of approximately 500 cases per year in the United States.

Surgery has been the primary therapy for renal cell adenocarcinoma for many decades. Until recently, metastatic disease has been refractory to any systemic therapy. With recent developments in systemic therapies, particularly immunotherapies, metastatic renal cell carcinoma may be approached aggressively in appropriate patients with a possibility of durable responses. Nevertheless, there is a remaining need for effective therapies for these patients.

Of all new cases of cancer in the United States, bladder cancer represents approximately 5 percent in men (fifth most common neoplasm) and 3 percent in women (eighth most common neoplasm). The incidence is increasing slowly, concurrent with an increasing older population. In 1998, there was an estimated 54,500 cases, including 39,500 in men and 15,000 in women. The age-adjusted incidence in the United States is 32 per 100,000 for men and eight per 100,000 in women. The historic male/female ratio of 3:1 may be decreasing related to smoking patterns in women. There were an estimated 11,000 deaths from bladder cancer in 1998 (7,800 in men and 3,900 in women). Bladder cancer incidence and mortality strongly increase with age and will be an increasing problem as the population becomes more elderly.

Most bladder cancers recur in the bladder. Bladder cancer is managed with a combination of transurethral resection of the bladder (TUR) and intravesical chemotherapy or immunotherapy. The multifocal and recurrent nature of bladder cancer points out the limitations of TUR. Most muscle-invasive cancers are not cured by TUR alone. Radical cystectomy and urinary diversion is the most effective means to eliminate the cancer but carry an undeniable impact on urinary and sexual function. There continues to be a significant need for treatment modalities that are beneficial for bladder cancer patients.

An estimated 130,200 cases of colorectal cancer occurred in 2000 in the United States, including 93,800 cases of colon cancer and 36,400 of rectal cancer. Colorectal cancers are the third most common cancers in men and women. Incidence rates declined significantly during 1992-1996 (−2.1% per year). Research suggests that these declines have been due to increased screening and polyp removal, preventing progression of polyps to invasive cancers. There were an estimated 56,300 deaths (47,700 from colon cancer, 8,600 from rectal cancer) in 2000, accounting for about 11% of all U.S. cancer deaths.

At present, surgery is the most common form of therapy for colorectal cancer, and for cancers that have not spread, it is frequently curative. Chemotherapy, or chemotherapy plus radiation, is given before or after surgery to most patients whose cancer has deeply perforated the bowel wall or has spread to the lymph nodes. A permanent colostomy (creation of an abdominal opening for elimination of body wastes) is occasionally needed for colon cancer and is infrequently required for rectal cancer. There continues to be a need for effective diagnostic and treatment modalities for colorectal cancer.

There were an estimated 164,100 new cases of lung and bronchial cancer in 2000, accounting for 14% of all U.S. cancer diagnoses. The incidence rate of lung and bronchial cancer is declining significantly in men, from a high of 86.5 per 100,000 in 1984 to 70.0 in 1996. In the 1990s, the rate of increase among women began to slow. In 1996, the incidence rate in women was 42.3 per 100,000.

Lung and bronchial cancer caused an estimated 156,900 deaths in 2000, accounting for 28% of all cancer deaths. During 1992-1996, mortality from lung cancer declined significantly among men (−1.7% per year) while rates for women were still significantly increasing (0.9% per year). Since 1987, more women have died each year of lung cancer than breast cancer, which, for over 40 years, was the major cause of cancer death in women. Decreasing lung cancer incidence and mortality rates most likely resulted from decreased smoking rates over the previous 30 years; however, decreasing smoking patterns among women lag behind those of men. Of concern, although the declines in adult tobacco use have slowed, tobacco use in youth is increasing again.

Treatment options for lung and bronchial cancer are determined by the type and stage of the cancer and include surgery, radiation therapy, and chemotherapy. For many localized cancers, surgery is usually the treatment of choice. Because the disease has usually spread by the time it is discovered, radiation therapy and chemotherapy are often needed in combination with surgery. Chemotherapy alone or combined with radiation is the treatment of choice for small cell lung cancer; on this regimen, a large percentage of patients experience remission, which in some cases is long lasting. There is however, an ongoing need for effective treatment and diagnostic approaches for lung and bronchial cancers.

An estimated 182,800 new invasive cases of breast cancer were expected to occur among women in the United States during 2000. Additionally, about 1,400 new cases of breast cancer were expected to be diagnosed in men in 2000. After increasing about 4% per year in the 1980s, breast cancer incidence rates in women have leveled off in the 1990s to about 110.6 cases per 100,000.

In the U.S. alone, there were an estimated 41,200 deaths (40,800 women, 400 men) in 2000 due to breast cancer. Breast cancer ranks second among cancer deaths in women. According to the most recent data, mortality rates declined significantly during 1992-1996 with the largest decreases in younger women, both white and black. These decreases were probably the result of earlier detection and improved treatment.

Taking into account the medical circumstances and the patient's preferences, treatment of breast cancer may involve lumpectomy (local removal of the tumor) and removal of the lymph nodes under the arm; mastectomy (surgical removal of the breast) and removal of the lymph nodes under the arm; radiation therapy; chemotherapy; or hormone therapy. Often, two or more methods are used in combination. Numerous studies have shown that, for early stage disease, long-term survival rates after lumpectomy plus radiotherapy are similar to survival rates after modified radical mastectomy. Significant advances in reconstruction techniques provide several options for breast reconstruction after mastectomy. Recently, such reconstruction has been done at the same time as the mastectomy.

Local excision of ductal carcinoma in situ (DCIS) with adequate amounts of surrounding normal breast tissue may prevent the local recurrence of the DCIS. Radiation to the breast and/or tamoxifen may reduce the chance of DCIS occurring in the remaining breast tissue. This is important because DCIS, if left untreated, may develop into invasive breast cancer. Nevertheless, there are serious side effects or sequelae to these treatments. There is, therefore, a need for efficacious breast cancer treatments.

There were an estimated 23,100 new cases of ovarian cancer in the United States in 2000. It accounts for 4% of all cancers among women and ranks second among gynecologic cancers. During 1992-1996, ovarian cancer incidence rates were significantly declining. Consequent to ovarian cancer, there were an estimated 14,000 deaths in 2000. Ovarian cancer causes more deaths than any other cancer of the female reproductive system.

Surgery, radiation therapy, and chemotherapy are treatment options for ovarian cancer. Surgery usually includes the removal of one or both ovaries, the fallopian tubes (salpingo-oophorectomy), and the uterus (hysterectomy). In some very early tumors, only the involved ovary will be removed, especially in young women who wish to have children. In advanced disease, an attempt is made to remove all intra-abdominal disease to enhance the effect of chemotherapy. There continues to be an important need for effective treatment options for ovarian cancer.

There were an estimated 28,300 new cases of pancreatic cancer in the United States in 2000. Over the past 20 years, rates of pancreatic cancer have declined in men. Rates among women have remained approximately constant but may be beginning to decline. Pancreatic cancer caused an estimated 28,200 deaths in 2000 in the United States. Over the past 20 years, there has been a slight but significant decrease in mortality rates among men (about −0.9% per year) while rates have increased slightly among women.

Surgery, radiation therapy, and chemotherapy are treatment options for pancreatic cancer. These treatment options can extend survival and/or relieve symptoms in many patients but are not likely to produce a cure for most. There is a significant need for additional therapeutic and diagnostic options for pancreatic cancer.

DISCLOSURE OF THE INVENTION

The present invention relates to a gene, designated PSCA, that has now been found to be over-expressed in the cancer(s) listed in Table I. Northern blot expression analysis of PSCA gene expression in normal tissues shows a restricted expression pattern in adult tissues. The nucleotide (FIG. 2) and amino acid (FIG. 2, and FIG. 3) sequences of PSCA are provided. The tissue-related profile of PSCA in normal adult tissues, combined with the over-expression observed in the tissues listed in Table I, shows that PSCA is aberrantly over-expressed in at least some cancers, and thus serves as a useful diagnostic, prophylactic, prognostic, and/or therapeutic target for cancers of the tissue(s) such as those listed in Table I.

The invention provides polynucleotides corresponding or complementary to all or part of the PSCA genes, mRNAs, and/or coding sequences, preferably in isolated form, including polynucleotides encoding PSCA-related proteins and fragments of 4, 5, 6, 7, 8, 9, 10, 11, 12, 13, 14, 15, 16, 17, 18, 19, 20, 21, 22, 23, 24, 25, or more than 25 contiguous amino acids; at least 30, 35, 40, 45, 50, 55, 60, 65, 70, 80, 85, 90, 95, 100 or more than 100 contiguous amino acids of a PSCA-related protein, as well as the peptides/proteins themselves; DNA, RNA, DNA/RNA hybrids, and related molecules, polynucleotides or oligonucleotides complementary or having at least a 90% homology to the PSCA genes or mRNA sequences or parts thereof, and polynucleotides or oligonucleotides that hybridize to the PSCA genes, mRNAs, or to PSCA-encoding polynucleotides. Also provided are means for isolating cDNAs and the genes encoding PSCA. Recombinant DNA molecules containing PSCA polynucleotides, cells transformed or transduced with such molecules, and host-vector systems for the expression of PSCA gene products are also provided. The invention further provides antibodies that bind to PSCA proteins and polypeptide fragments thereof, including polyclonal and monoclonal antibodies, murine and other mammalian antibodies, chimeric antibodies, humanized and fully human antibodies, and antibodies labeled with a detectable marker or therapeutic agent. In certain embodiments, there is a proviso that the entire nucleic acid sequence of FIG. 2 is not encoded and/or the entire amino acid sequence of FIG. 2 is not prepared. In certain embodiments, the entire nucleic acid sequence of FIG. 2 is encoded and/or the entire amino acid sequence of FIG. 2 is prepared, either of which are in respective human unit dose forms.

The invention further provides methods for detecting the presence and status of PSCA polynucleotides and proteins in various biological samples, as well as methods for identifying cells that express PSCA. A typical embodiment of this invention provides methods for monitoring PSCA gene products in a tissue or hematology sample having or suspected of having some form of growth dysregulation such as cancer.

The invention further provides various immunogenic or therapeutic compositions and strategies for treating cancers that express PSCA such as cancers of tissues listed in Table I, including therapies aimed at inhibiting the transcription, translation, processing or function of PSCA as well as cancer vaccines. In one aspect, the invention provides compositions, and methods comprising them, for treating a cancer that expresses PSCA in a human subject wherein the composition comprises a carrier suitable for human use and a human unit dose of one or more than one agent that inhibits the production or function of PSCA. Preferably, the carrier is a uniquely human carrier. In another aspect of the invention, the agent is a moiety that is immunoreactive with PSCA protein. Non-limiting examples of such moieties include, but are not limited to, antibodies (such as single chain, monoclonal, polyclonal, humanized, chimeric, or human antibodies), functional equivalents thereof (whether naturally occurring or synthetic), and combinations thereof. The antibodies can be conjugated to a diagnostic or therapeutic moiety. In another aspect, the agent is a small molecule as defined herein.

In another aspect, the agent comprises one or more than one peptide which comprises a cytotoxic T lymphocyte (CTL) epitope that binds an HLA class I molecule in a human to elicit a CTL response to PSCA and/or one or more than one peptide which comprises a helper T lymphocyte (HTL) epitope which binds an HLA class II molecule in a human to elicit an HTL response. The peptides of the invention may be on the same or on one or more separate polypeptide molecules. In a further aspect of the invention, the agent comprises one or more than one nucleic acid molecule that expresses one or more than one of the CTL or HTL response stimulating peptides as described above. In yet another aspect of the invention, the one or more than one nucleic acid molecule may express a moiety that is immunologically reactive with PSCA as described above. The one or more than one nucleic acid molecule may also be, or encodes, a molecule that inhibits production of PSCA. Non-limiting examples of such molecules include, but are not limited to, those complementary to a nucleotide sequence essential for production of PSCA (e.g. antisense sequences or molecules that form a triple helix with a nucleotide double helix essential for PSCA production) or a ribozyme effective to lyse PSCA mRNA.

Note that to determine the starting position of any peptide set forth in Tables VIII-XXI and XXII to XLIX (collectively HLA Peptide Tables) respective to its parental protein, e.g., variant 1, variant 2, etc., reference is made to three factors: the particular variant, the length of the peptide in an HLA Peptide Table, and the Search Peptides in Table VII. Generally, a unique Search Peptide is used to obtain HLA peptides of a particular for a particular variant. The position of each Search Peptide relative to its respective parent molecule is listed in Table VII. Accordingly, if a Search Peptide begins at position "X", one must add the value "X−1" to each position in Tables VIII-XXI and XXII to XLIX to obtain the actual position of the HLA peptides in their parental molecule. For example, if a particular Search Peptide begins at position 150 of its parental molecule, one must add 150−1, i.e., 149 to each HLA peptide amino acid position to calculate the position of that amino acid in the parent molecule.

One embodiment of the invention comprises an HLA peptide, that occurs at least twice in Tables VIII-XXI and XXII to XLIX collectively, or an oligonucleotide that encodes the HLA peptide. Another embodiment of the invention comprises an HLA peptide that occurs at least once in Tables VIII-XXI and at least once in tables XXII to XLIX, or an oligonucleotide that encodes the HLA peptide.

Another embodiment of the invention is antibody epitopes, which comprise a peptide regions, or an oligonucleotide encoding the peptide region, that has one two, three, four, or five of the following characteristics:

i) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Hydrophilicity profile of FIG. 5;
ii) a peptide region of at least 5 amino acids of a particular peptide of FIG. 3, in any whole number increment up to the full length of that protein in FIG. 3, that includes an amino acid position having a value equal to or less than 0.5, 0.4, 0.3, 0.2, 0.1, or having a value equal to 0.0, in the Hydropathicity profile of FIG. 6;
iii) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Percent Accessible Residues profile of FIG. 7;
iv) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Average Flexibility profile of FIG. 8; or
v) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Beta-turn profile of FIG. 9.

BRIEF DESCRIPTION OF THE DRAWINGS

FIG. 1(A): Primers were designed to differentiate between PSCA v.4 and PSCA v.5. PSCA v.4 lead to a PCR product of 460 bp, whereas PSCA v.5 leads to a PCR product of 945 bp in size.

Figure 1B:
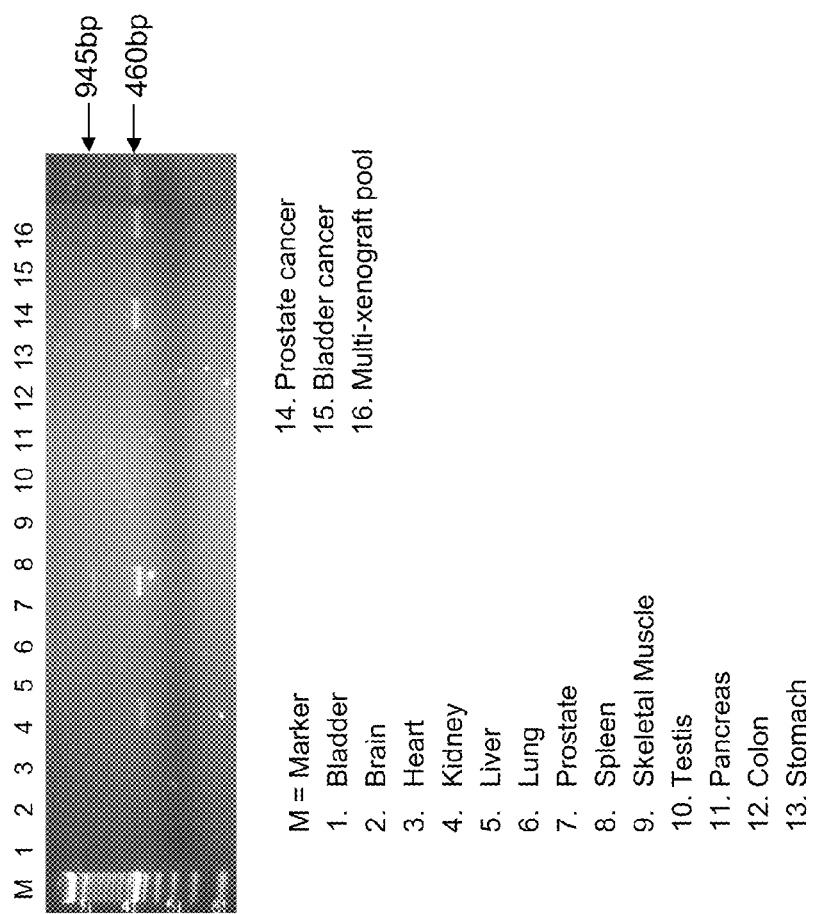
FIG. 1(B): First strand cDNA was prepared from normal bladder, brain, heart, kidney, liver, lung, prostate, spleen, skel, muscle, testis, pancreas, colon, stomach, pools of prostate cancer, bladder cancer, and multi-xenograft pool (prostate cancer, kidney cancer and bladder cancer xenografts). Normalization was performed by PCR using primers to actin. Semi-quantitative PCR, using the variant specific primers was performed at 30 cycles of amplification. Results show expression of PSCA v.4 in prostate cancer, bladder cancer, and multi-xenograft pool, normal kidney and prostate, PSCA v.5 was detected only in normal prostate and bladder cancer.

B) The cDNA and amino acid sequence of PSCA variant 2 (also called "PSCA v.2") is shown in FIG. 2B. The codon for the start methionine is underlined. The open reading frame extends from nucleic acid 56-427 including the stop codon.

C) The cDNA and amino acid sequence of PSCA variant 3 (also called "PSCA v.3") is shown in FIG. 2C. The codon for the start methionine is underlined. The open reading frame extends from nucleic acid 423-707 including the stop codon.

D) The cDNA and amino acid sequence of PSCA variant 4 (also called "PSCA v.4") is shown in FIG. 2D. The codon for the start methionine is underlined. The open reading frame extends from nucleic acid 424-993 including the stop codon.

E) The cDNA and amino acid sequence of PSCA variant 5 (also called "PSCA v.5") is shown in FIG. 2E. The codon for the start methionine is underlined. The open reading frame extends from nucleic acid 910-1479 including the stop codon.

F) The cDNA and amino acid sequence of PSCA variant 6 (also called "PSCA v.6") is shown in FIG. 2F. The codon for the start methionine is underlined. The open reading frame extends from nucleic acid 83-427 including the stop codon.

G) SNP variants of PSCA v.2, PSCA v.7 through v.18. The PSCA v.7 through v.18 proteins have 123 amino acids. Variants PSCA v.7 through v.18 are variants with single nucleotide difference from PSCA v.2, and code for the same protein as v.2. Though these SNP variants are shown separately, they can also occur in any combinations and in any of the transcript variants listed above in FIGS. 2A through 2F.

H) SNP variants of PSCA v.4, PSCA v.19 through v.30. The PSCA v.19 through v.30 proteins have 189 amino acids. Variants PSCA v.19 through v.30 are variants with single nucleotide difference from PSCA v.4. PSCA v.9, v.10, v.11, v.24 and v.25 proteins differ from PSCA v.1 by one amino acid. PSCA v.23, v.28, v.29 and v.30 code for the same protein as v.4. Though these SNP variants are shown separately, they can also occur in any combinations and in any of the transcript variants v.3 and v.4.

Figures 1, 12A:
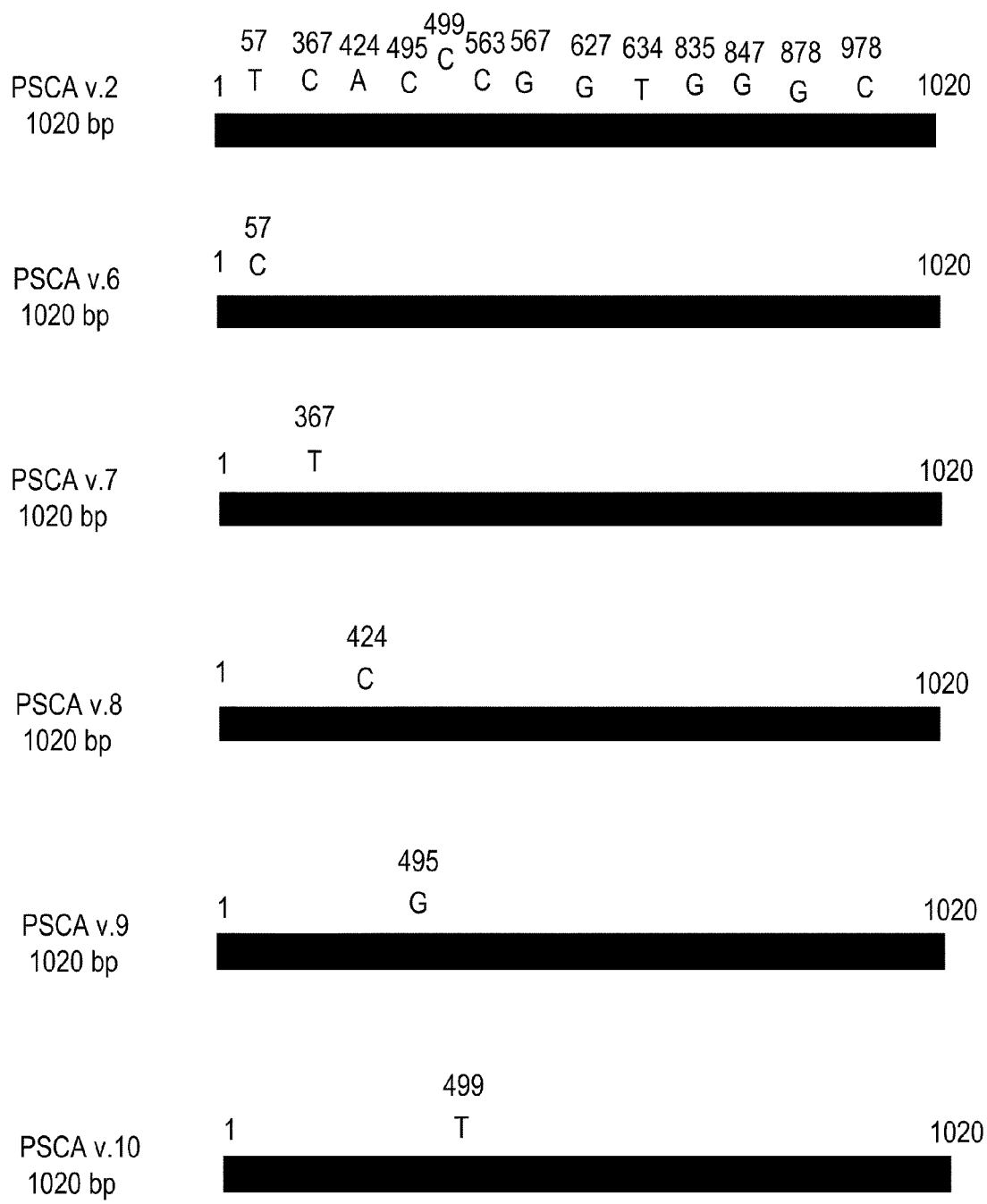
Figures 2, 12A:
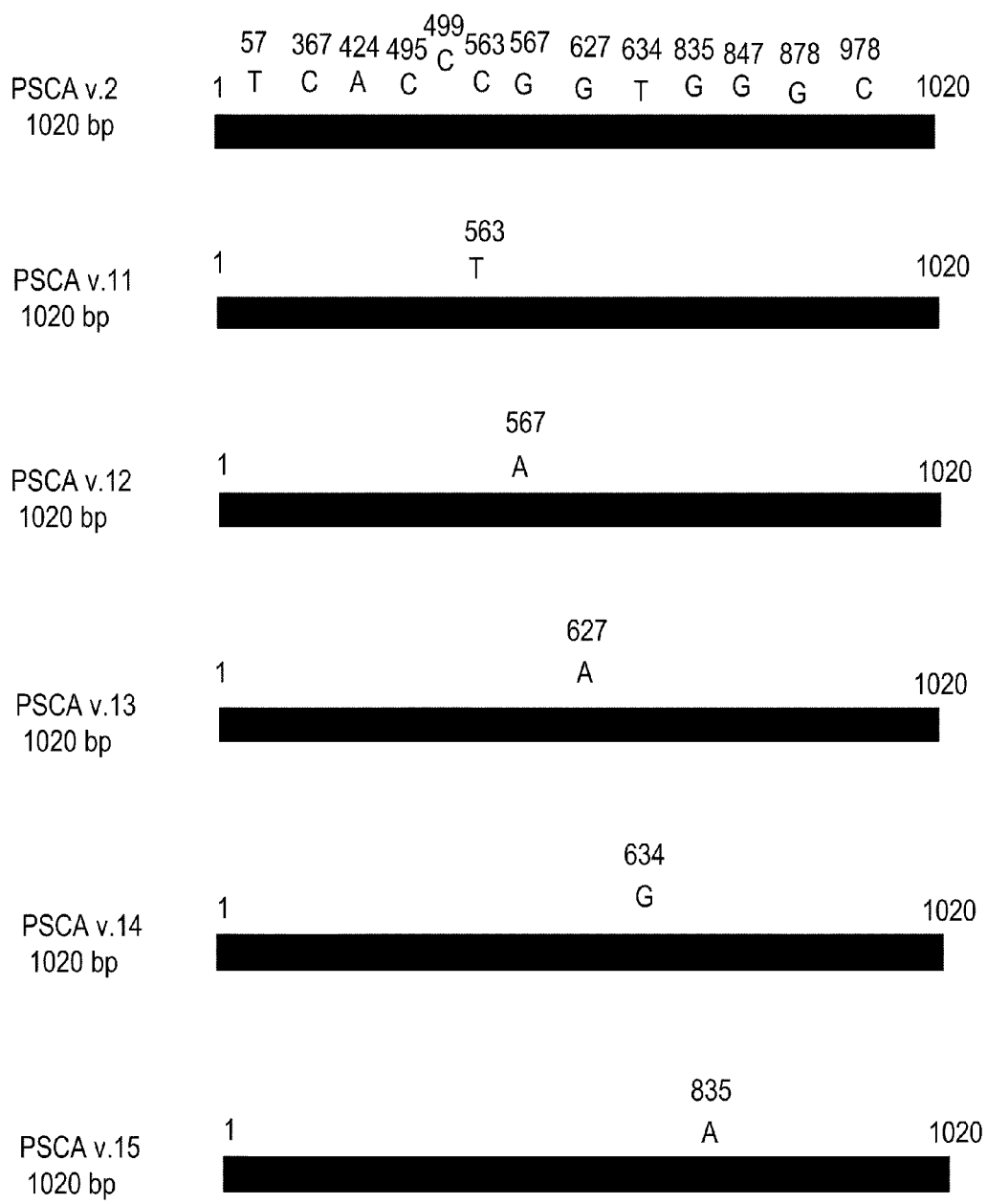
Figures 3, 12A:
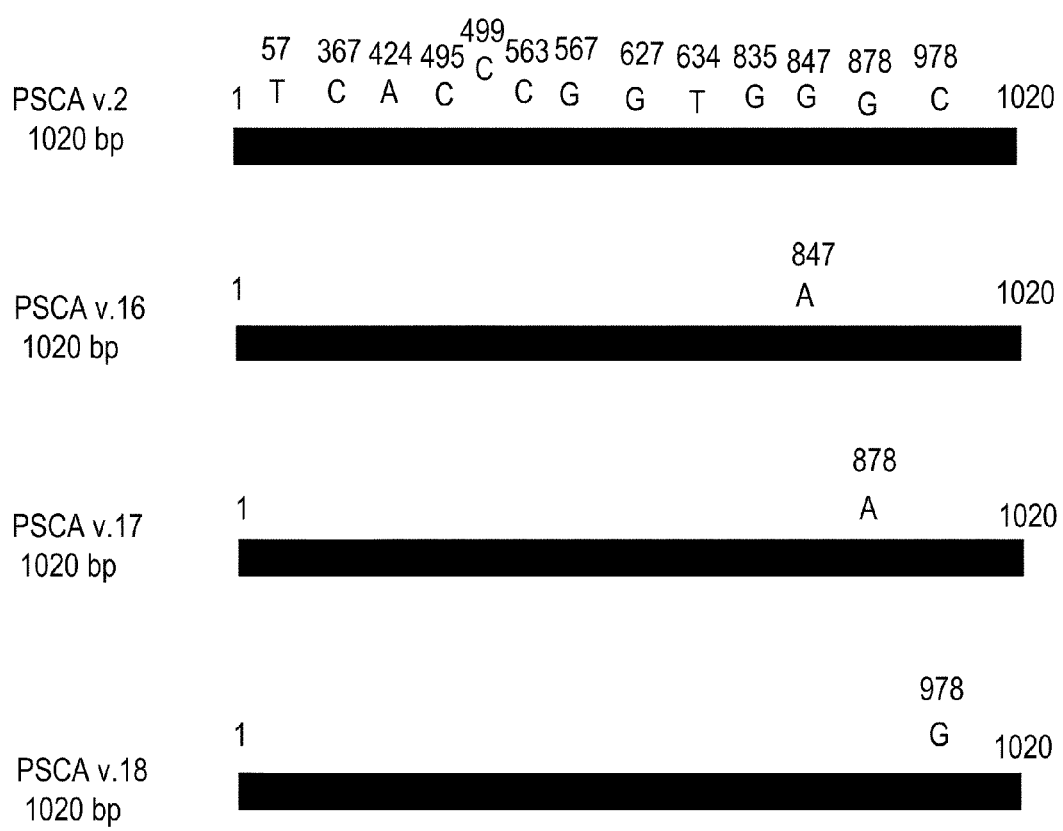

FIG. 3.
A) The amino acid sequence of PSCA v.1 is shown in FIG. 3A; it has 123 amino acids.
B) The amino acid sequence of PSCA v.3 is shown in FIG. 3B; it has 94 amino acids.
C) The amino acid sequence of PSCA v.4 is shown in FIG. 3C; it has 189 amino acids.
D) The amino acid sequence of PSCA v.6 is shown in FIG. 3D; it has 114 amino acids.
E) The amino acid sequence of PSCA v.19 is shown in FIG. 3E; it has 189 amino acids.
F) The amino acid sequence of PSCA v.20 is shown in FIG. 3F; it has 189 amino acids.
G) The amino acid sequence of PSCA v.21 is shown in FIG. 3G; it has 189 amino acids.
H) The amino acid sequence of PSCA v.22 is shown in FIG. 3H; it has 189 amino acids.
I) The amino acid sequence of PSCA v.24 is shown in FIG. 3I; it has 189 amino acids.
J) The amino acid sequence of PSCA v.25 is shown in FIG. 3J; it has 189 amino acids.
K) The amino acid sequence of PSCA v.26 is shown in FIG. 3k; it has 189 amino acids.
L) The amino acid sequence of PSCA v.27 is shown in FIG. 3L; it has 189 amino acids.

As used herein, a reference to PSCA includes all variants thereof, including those shown in FIGS. 2, 3, 10, 11, and 12 unless the context clearly indicates otherwise.

FIG. 4. Alignment of PSCA v.4 (SEQ ID NO: 6540) with human Prostate Stem Cell Antigen (gi 27482160) (SEQ ID NO: 6556).

FIG. 5. FIGS. 5(a)-(c): Hydrophilicity amino acid profile of PSCAv.1, v.3, and v.4 determined by computer algorithm sequence analysis using the method of Hopp and Woods (Hopp T. P., Woods K. R., 1981. Proc. Natl. Acad. Sci. U.S.A. 78:3824-3828) accessed on the Protscale website located on the World Wide Web at (expasy.ch/cgi-bin/protscale.pl) through the ExPasy molecular biology server.

FIG. 6. FIGS. 6(a)-(c): Hydropathicity amino acid profile of PSCAv.1, v.3, and v.4 determined by computer algorithm sequence analysis using the method of Kyte and Doolittle (Kyte J., Doolittle R. F., 1982. J. Mol. Biol. 157:105-132) accessed on the ProtScale website located on the World Wide Web at (.expasy.ch/cgi-bin/protscale.pl) through the ExPasy molecular biology server.

FIG. 7. FIGS. 7(a)-(c): Percent accessible residues amino acid profile of PSCAv.1, v.3, and v.4 determined by computer algorithm sequence analysis using the method of Janin (Janin J., 1979 Nature 277:491-492) accessed on the ProtScale website located on the World Wide Web at (.expasy.ch/cgi-bin/ protscale.pl) through the ExPasy molecular biology server.

FIG. 8. FIGS. 8(a)-(c): Average flexibility amino acid profile of PSCAv.1, v.3, and v.4 determined by computer algorithm sequence analysis using the method of Bhaskaran and Ponnuswamy (Bhaskaran R., and Ponnuswamy P. K., 1988. Int. J. Pept. Protein Res. 32:242-255) accessed on the ProtScale website located on the World Wide Web at (.expasy.ch/cgi-bin/protscale.pl) through the ExPasy molecular biology server.

FIG. 9. FIGS. 9(a)-(c): Beta-turn amino acid profile of PSCAv.1, v.3, and v.4 determined by computer algorithm sequence analysis using the method of Deleage and Roux (Deleage, G., Roux B. 1987 Protein Engineering 1:289-294) accessed on the ProtScale website located on the World Wide Web at (.expasy.ch/cgi-bin/protscale.pl) through the ExPasy molecular biology server.

Figure 10:
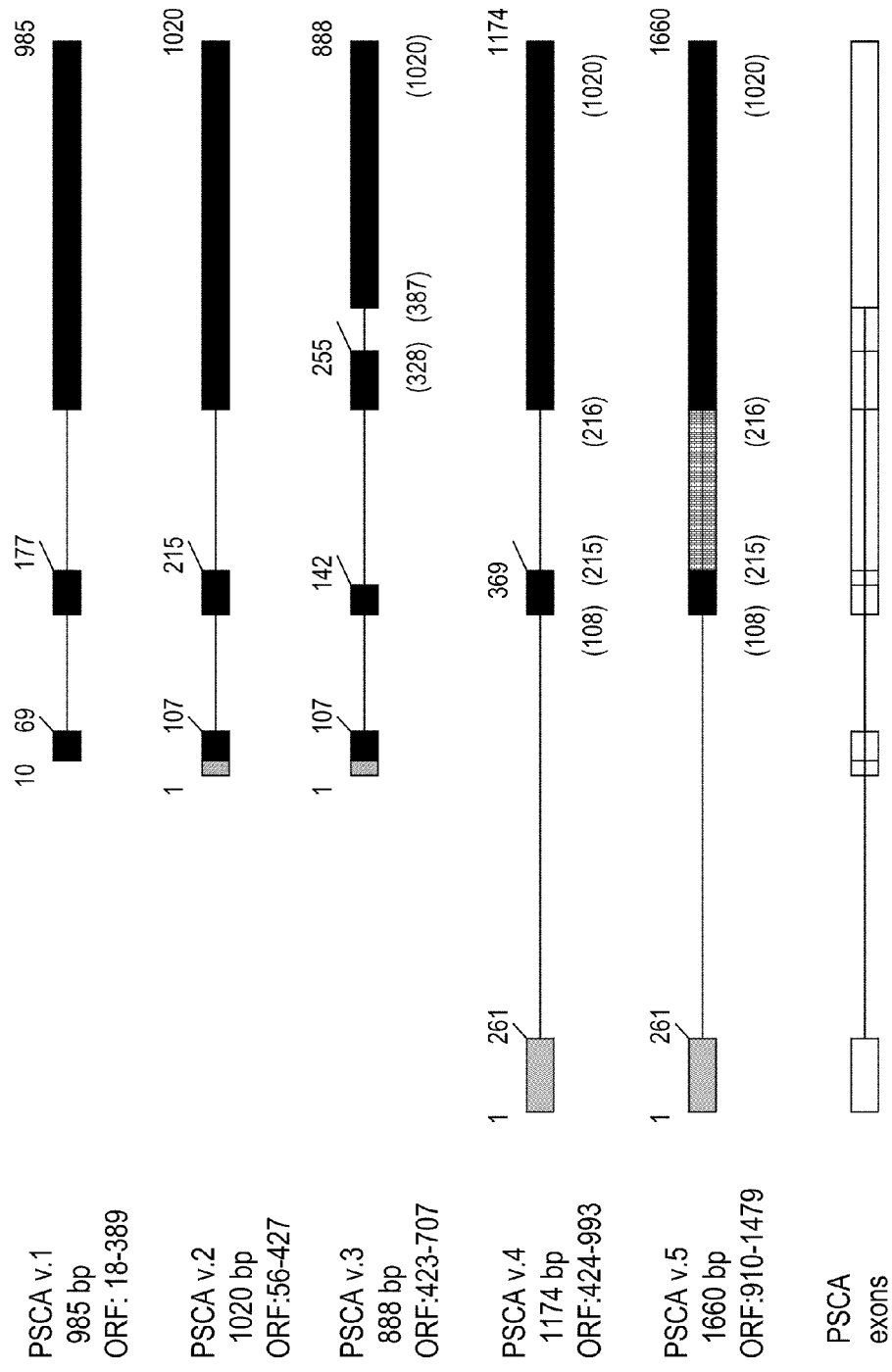

FIG. 10. Exon compositions of transcript variants of PSCA. Variant PSCA v.2, v.3, v.4 and v.5 are transcript variants of v.1. Variant v.2 started transcription 47 bp further to the 5' end than v.1. Variant v.3 had a shorter exon 2 as compared to v.2. Variants v.4 and v.5 had an alternative first exon. Variant 5 kept the second intron as compared to v.4. The order of the potential exons on the human genome is shown at the bottom. Poly A tails were not shown in the figure. Ends of exons are shown above the boxes. Numbers in "( )" underneath the boxes correspond to those of PSCA v.2. Lengths of introns and exons are not proportional.

Figure 11A:
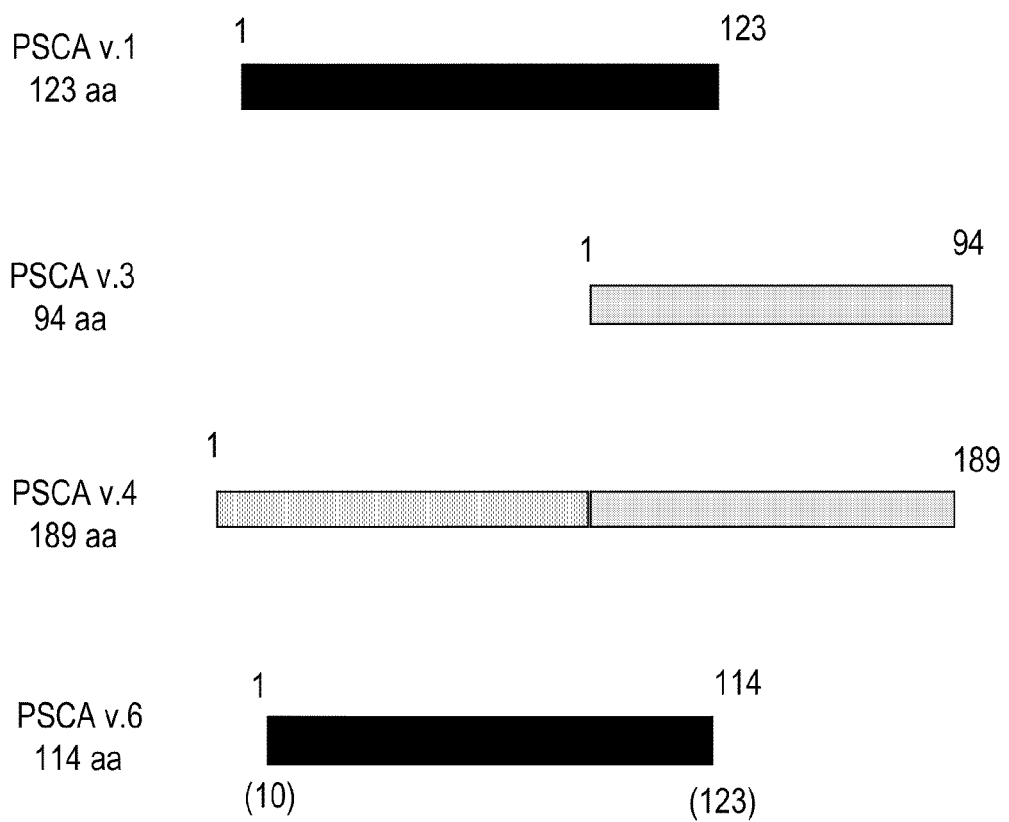
Figures 1, 11B:
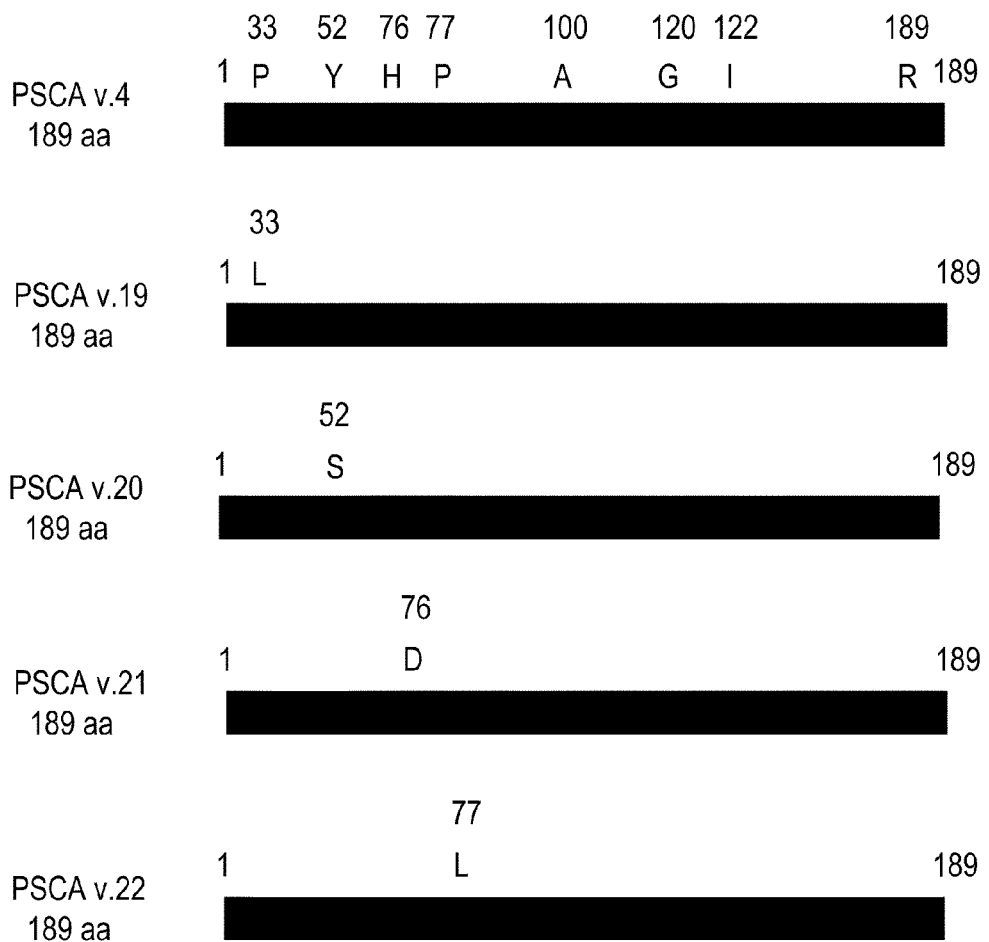
FIG. 1. Expression of PSCA v.4 and PSCA v.5.

FIG. 11. FIG. 11(a): Schematic alignment of protein variants of PSCA. Protein variants correspond to nucleotide variants. Nucleotide variants PSCA v.2, v.7 through v.18 coded the same protein as v.1. Variant v.5 coded the same protein as v.4 and protein v.3 was part of v.4. Nucleotide variants PSCA v.2, v.3, v.4 and v.5 were transcript variants of v.1, as shown in FIG. 10. The SNP in v.2 that did not cause codon change in v.2 caused a codon change in v.3, v.4, and v.5. Single amino acid differences were indicated above the boxes. Black boxes represent the same sequence as PSCA v.1. Numbers underneath the box correspond to PSCA v.1. FIG. 11(b): Schematic alignment of protein variants translated from SNP variants of PSCA v.4. Protein variants correspond to nucleotide variants. Nucleotide variants PSCA v.23, v.28, v.29 and v.30 coded the same protein as v.4. SNP in v.4 that resulted in an amino acid change in v.4 and also resulted in an amino acid change in v.5 and if occurring between aa 96-189, also in v.3. Single amino acid differences were indicated above the boxes. Black boxes represent the same sequence as PSCA v.4. Numbers underneath the box correspond to PSCA v.4.

FIG. 12. FIG. 12(a): Schematic alignment of SNP variants of PSCA v.2. Variants PSCA v.6 through v.18 are variants with single nucleotide differences as compared to variant v.2. Variant v.6 changed the ORF from 56-427 to 83-427. Though these SNP variants were shown separately, they could also occur in any combinations and in any transcript variants, such as v.4 shown in FIG. 12, that contained the base pairs. Numbers correspond to those of PSCA v.2. Black box shows the same sequence as PSCA v.2. SNPs are indicated above the box. FIG. 12(b): Schematic alignment of SNP variants of PSCA v.4. Variants PSCA v.19 through v.30 are variants with single nucleotide differences as compared to variant v.4 (ORF:424-993). Though these SNP variants were shown separately, they could also occur in any combinations and in any transcript variants that contained the base pairs, such as v.5 shown in FIG. 10,. Numbers correspond to those of PSCA v.4. Black box shows the same sequence as PSCA v.4. SNPs are indicated above the box.

FIG. 13. Secondary structure and transmembrane domains prediction for PSCA protein variants.

FIGS. 13A, 13B, 13C, and 13D: The secondary structure of PSCA protein variant 1 (SEQ ID NO:6532), variant 3 (SEQ ID NO:6536), variant 4 (SEQ ID NO:6540), and variant 6 (SEQ ID NO:6546) (FIGS. A-D, respectively) were predicted using the HNN—Hierarchical Neural Network method (NPS @: Network Protein Sequence Analysis TIBS 2000 March Vol. 25, No 3 [291]:147-150 Combet C., Blanchet C., Geourjon C. and Deléage G., located on the World Wide Web at pbil.ibcp.fr/cgi-bin/npsa_automat.pl?page=npsa_nn.html), accessed from the ExPasy molecular biology server located on the World Wide Web at (.expasy.ch/tools/). This method predicts the presence and location of alpha helices, extended strands, and random coils from the primary protein sequence. The percent of each protein in a given secondary structure is also listed.

FIGS. 13E, 13G, 13I, and 13K: Schematic representation of the probability of existence of transmembrane regions of PSCA variants 1,3,4, and 6, respectively based on the TMpred algorithm of Hofmann and Stoffel which utilizes TMBASE (K. Hofmann, W. Stoffel. TMBASE—A database of membrane spanning protein segments Biol. Chem. Hoppe-Seyler 374:166, 1993). FIGS. 13F, 13H, 13J, and 13L: Schematic representation of the probability of the existence of transmembrane regions of PSCA variant 1, based on the TMHMM algorithm of Sonnhammer, von Heijne, and Krogh (Erik L. L. Sonnhammer, Gunnar von Heijne, and Anders Krogh: A hidden Markov model for predicting transmembrane helices in protein sequences. In Proc. of Sixth Int. Conf. on Intelligent Systems for Molecular Biology, p 175-182 Ed J. Glasgow, T. Littlejohn, F. Major, R. Lathrop, D. Sankoff, and C. Sensen Menlo Park, Calif.: AAAI Press, 1998). The TMpred and TMHMM algorithms are accessed from the ExPasy molecular biology server located on the World Wide Web at (expasy.ch/tools/).

Figure 14A:
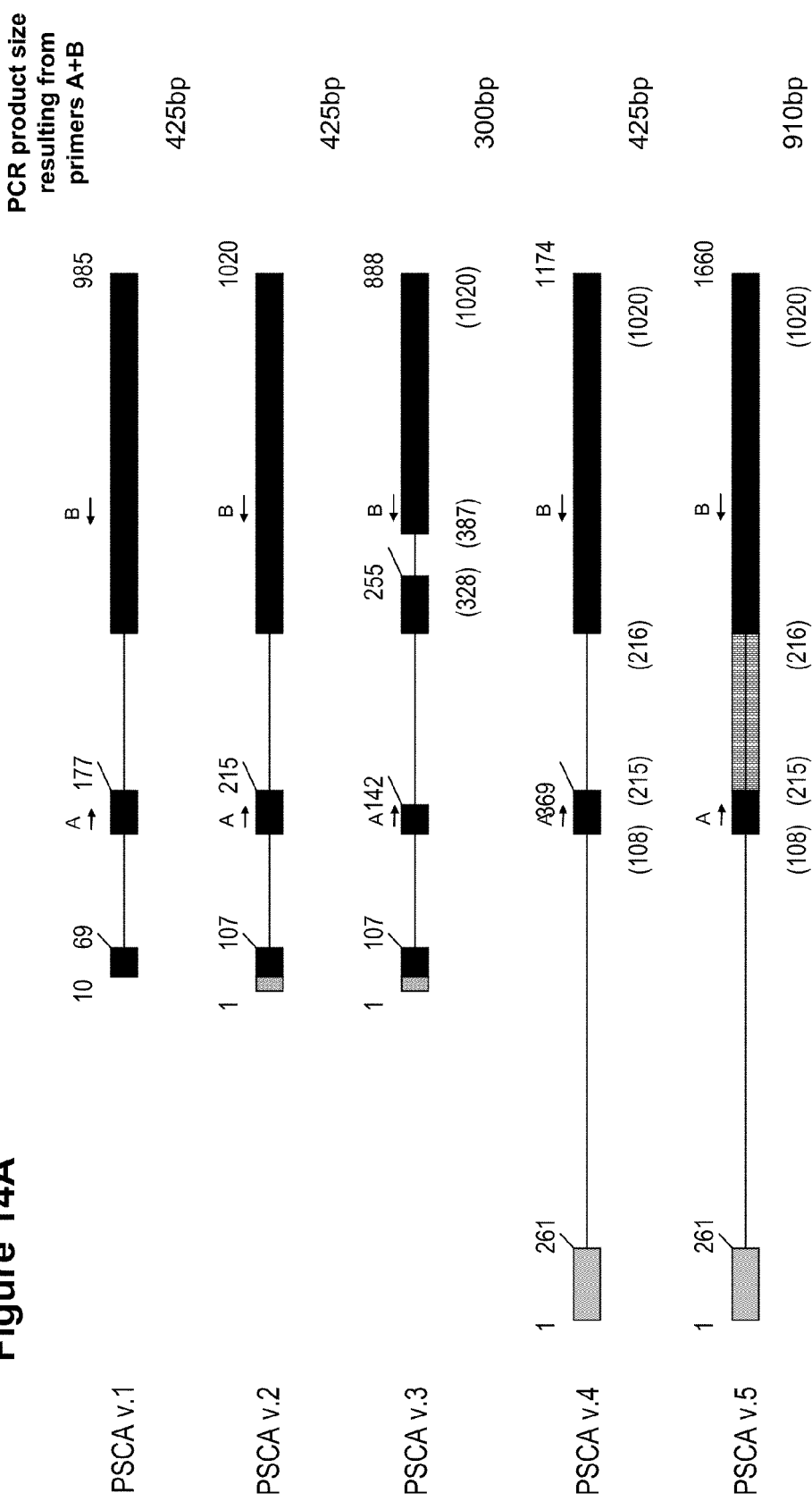
Figure 14B:
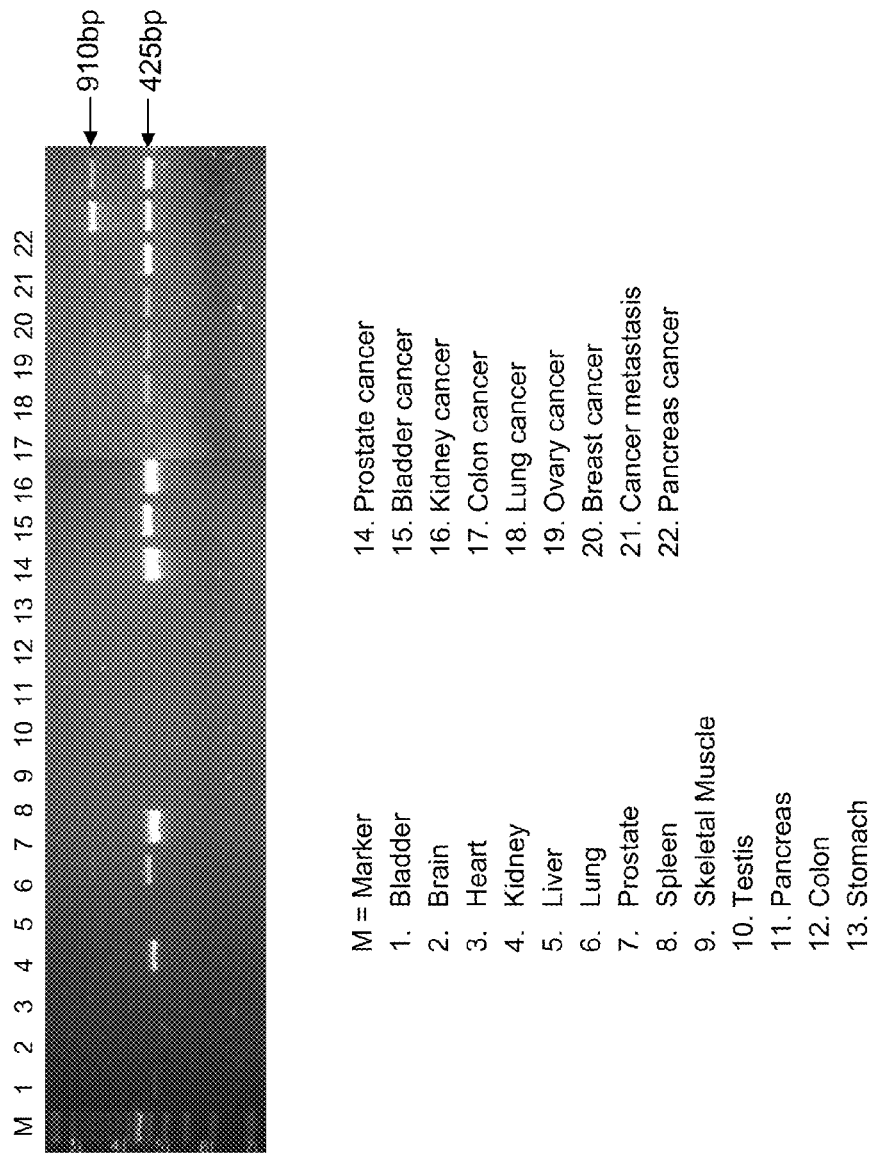

FIG. 14. Expression of PSCA variants. FIG. 14(A): Primers were designed to differentiate between PSCA v.1/v.2/v.4, PSCA v.3 and PSCA v.5. PSCA v.1/v.2/v.4 lead to a PCR product of 425 bp, PSCA v.3 leads to a PCR product of 300 bp, whereas PSCA v.5 leads to a PCR product of 910 bp in size. FIG. 14(B): First strand cDNA was prepared from normal bladder, brain, heart, kidney, liver, lung, prostate, spleen, skeletal muscle, testis, pancreas, colon, stomach, pools of prostate cancer, bladder cancer, kidney cancer, colon cancer, lung cancer, ovary cancer, breast cancer, cancer metastasis, and pancreas cancer. Normalization was performed by PCR using primers to actin. Semi-quantitative PCR, using the variant specific primers was performed at 30 cycles of amplification. Results show expression of PSCA v.5 mainly in breast cancer, cancer metastasis, and pancreas cancer, and at lower level in colon cancer and lung cancer. PSCA v.1/v.2/v.4 PCR product was detected in prostate cancer, bladder cancer, kidney cancer, colon cancer, lung cancer, ovary cancer, breast cancer, cancer metastasis, and pancreas cancer. Amongst normal tissues, PSCA v.1//v.2/v.4 PCR product was detected only in prostate, stomach and at lower level in kidney and lung, whereas PSCA v.5 was not detected in any normal tissue. PSCA v.3 PCR detected product was not detected in any of the samples tested.

MODES OF CARRYING OUT THE INVENTION

Outline of Sections
I.) Definitions
II.) PSCA Polynucleotides
II.A.) Uses of PSCA Polynucleotides
   II.A.1.) Monitoring of Genetic Abnormalities
   II.A.2.) Antisense Embodiments
   II.A.3.) Primers and Primer Pairs
   II.A.4.) Isolation of PSCA-Encoding Nucleic Acid Molecules
   II.A.5.) Recombinant Nucleic Acid Molecules and Host-Vector Systems
III.) PSCA-related Proteins
III.A.) Motif-bearing Protein Embodiments
III.B.) Expression of PSCA-related Proteins
III.C.) Modifications of PSCA-related Proteins
III.D.) Uses of PSCA-related Proteins
IV.) PSCA Antibodies
V.) PSCA Cellular Immune Responses
VI.) PSCA Transgenic Animals
VII.) Methods for the Detection of PSCA
VIII.) Methods for Monitoring the Status of PSCA-related Genes and Their Products
IX.) Identification of Molecules That Interact With PSCA
X.) Therapeutic Methods and Compositions
X.A.) Anti-Cancer Vaccines
X.B.) PSCA as a Target for Antibody-Based Therapy
X.C.) PSCA as a Target for Cellular Immune Responses
   X.C.1. Minigene Vaccines
   X.C.2. Combinations of CTL Peptides with Helper Peptides
   X.C.3. Combinations of CTL Peptides with T Cell Priming Agents
   X.C.4. Vaccine Compositions Comprising DC Pulsed with CTL and/or HTL Peptides
X.D.) Adoptive Immunotherapy
X.E.) Administration of Vaccines for Therapeutic or Prophylactic Purposes
XI.) Diagnostic and Prognostic Embodiments of PSCA.
XII.) Inhibition of PSCA Protein Function
XII.A.) Inhibition of PSCA With Intracellular Antibodies
XII.B.) Inhibition of PSCA with Recombinant Proteins
XII.C.) Inhibition of PSCA Transcription or Translation
XII.D.) General Considerations for Therapeutic Strategies
XIII.) Identification, Characterization and Use of Modulators of PSCA
XIV.) KITS/Articles of Manufacture
I.) Definitions:

Unless otherwise defined, all terms of art, notations and other scientific terms or terminology used herein are intended to have the meanings commonly understood by those of skill in the art to which this invention pertains. In some cases, terms with commonly understood meanings are defined herein for clarity and/or for ready reference, and the inclusion of such definitions herein should not necessarily be construed to represent a substantial difference over what is generally understood in the art. Many of the techniques and procedures described or referenced herein are well understood and commonly employed using conventional methodology by those skilled in the art, such as, for example, the widely utilized molecular cloning methodologies described in Sambrook et al., Molecular Cloning: A Laboratory Manual 2nd. edition (1989) Cold Spring Harbor Laboratory Press, Cold Spring Harbor, N.Y. As appropriate, procedures involving the use of commercially available kits and reagents are generally carried out in accordance with manufacturer defined protocols and/or parameters unless otherwise noted.

The terms "advanced prostate cancer", "locally advanced prostate cancer", "advanced disease" and "locally advanced disease" mean prostate cancers that have extended through the prostate capsule, and are meant to include stage C disease under the American Urological Association (AUA) system, stage C1-C2 disease under the Whitmore-Jewett system, and stage T3-T4 and N+ disease under the TNM (tumor, node, metastasis) system. In general, surgery is not recommended for patients with locally advanced disease, and these patients have substantially less favorable outcomes compared to patients having clinically localized (organ-confined) prostate cancer. Locally advanced disease is clinically identified by palpable evidence of induration beyond the lateral border of the prostate, or asymmetry or induration above the prostate base. Locally advanced prostate cancer is presently diagnosed pathologically following radical prostatectomy if the tumor invades or penetrates the prostatic capsule, extends into the surgical margin, or invades the seminal vesicles.

"Altering the native glycosylation pattern" is intended for purposes herein to mean deleting one or more carbohydrate moieties found in native sequence PSCA (either by removing the underlying glycosylation site or by deleting the glycosylation by chemical and/or enzymatic means), and/or adding one or more glycosylation sites that are not present in the native sequence PSCA. In addition, the phrase includes qualitative changes in the glycosylation of the native proteins, involving a change in the nature and proportions of the various carbohydrate moieties present.

The term "analog" refers to a molecule which is structurally similar or shares similar or corresponding attributes with another molecule (e.g. a PSCA-related protein). For example, an analog of a PSCA protein can be specifically bound by an antibody or T cell that specifically binds to PSCA.

The term "antibody" is used in the broadest sense. Therefore, an "antibody" can be naturally occurring or man-made such as monoclonal antibodies produced by conventional hybridoma technology. Anti-PSCA antibodies comprise monoclonal and polyclonal antibodies as well as fragments containing the antigen-binding domain and/or one or more complementarity determining regions of these antibodies.

An "antibody fragment" is defined as at least a portion of the variable region of the immunoglobulin molecule that binds to its target, i.e., the antigen-binding region. In one embodiment it specifically covers single anti-PSCA antibodies and clones thereof (including agonist, antagonist and neutralizing antibodies) and anti-PSCA antibody compositions with polyepitopic specificity.

The term "codon optimized sequences" refers to nucleotide sequences that have been optimized for a particular host species by replacing any codons having a usage frequency of less than about 20%. Nucleotide sequences that have been optimized for expression in a given host species by elimination of spurious polyadenylation sequences, elimination of exon/intron splicing signals, elimination of transposon-like repeats and/or optimization of GC content in addition to codon optimization are referred to herein as an "expression enhanced sequences."

A "combinatorial library" is a collection of diverse chemical compounds generated by either chemical synthesis or biological synthesis by combining a number of chemical "building blocks" such as reagents. For example, a linear combinatorial chemical library, such as a polypeptide (e.g., mutein) library, is formed by combining a set of chemical building blocks called amino acids in every possible way for a given compound length (i.e., the number of amino acids in a polypeptide compound). Numerous chemical compounds are synthesized through such combinatorial mixing of chemical building blocks (Gallop et al., J. Med. Chem. 37(9): 1233-1251 (1994)).

Preparation and screening of combinatorial libraries is well known to those of skill in the art. Such combinatorial chemical libraries include, but are not limited to, peptide libraries (see, e.g., U.S. Pat. No. 5,010,175, Furka, Pept. Prot. Res. 37:487-493 (1991), Houghten et al., Nature, 354:84-88 (1991)), peptoids (PCT Publication No WO 91/19735), encoded peptides (PCT Publication WO 93/20242), random bio-oligomers (PCT Publication WO 92/00091), benzodiazepines (U.S. Pat. No. 5,288,514), diversomers such as hydantoins, benzodiazepines and dipeptides (Hobbs et al., Proc. Nat. Acad. Sci. USA 90:6909-6913 (1993)), vinylogous polypeptides (Hagihara et al., J. Amer. Chem. Soc. 114:6568 (1992)), nonpeptidal peptidomimetics with a Beta-D-Glucose scaffolding (Hirschmann et al., J. Amer. Chem. Soc. 114:9217-9218 (1992)), analogous organic syntheses of small compound libraries (Chen et al., J. Amer. Chem. Soc. 116:2661 (1994)), oligocarbarnates (Cho, et al., Science 261: 1303 (1993)), and/or peptidyl phosphonates (Campbell et al., J. Org. Chem. 59:658 (1994)). See, generally, Gordon et al., J. Med. Chem. 37:1385 (1994), nucleic acid libraries (see, e.g., Stratagene, Corp.), peptide nucleic acid libraries (see, e.g., U.S. Pat. No. 5,539,083), antibody libraries (see, e.g., Vaughn et al., Nature Biotechnology 14(3): 309-314 (1996), and PCT/US96/10287), carbohydrate libraries (see, e.g., Liang et al., Science 274:1520-1522 (1996), and U.S. Pat. No. 5,593,853), and small organic molecule libraries (see, e.g., benzodiazepines, Baum, C&EN, January 18, page 33 (1993); isoprenoids, U.S. Pat. No. 5,569,588; thiazolidinones and metathiazanones, U.S. Pat. No. 5,549,974; pyrrolidines, U.S. Pat. Nos. 5,525,735 and 5,519,134; morpholino compounds, U.S. Pat. No. 5,506, 337; benzodiazepines, U.S. Pat. No. 5,288, 514; and the like).

Devices for the preparation of combinatorial libraries are commercially available (see, e.g., 357 NIPS, 390 NIPS, Advanced Chem Tech, Louisville Ky.; Symphony, Rainin, Woburn, Mass.; 433A, Applied Biosystems, Foster City, Calif.; 9050, Plus, Millipore, Bedford, NIA). A number of well-known robotic systems have also been developed for solution phase chemistries. These systems include automated workstations such as the automated synthesis apparatus developed by Takeda Chemical Industries, LTD. (Osaka, Japan) and many robotic systems utilizing robotic arms (Zymate H, Zymark Corporation, Hopkinton, Mass.; Orca, Hewlett-Packard, Palo Alto, Calif.), which mimic the manual synthetic operations performed by a chemist. Any of the above devices are suitable for use with the present invention. The nature and implementation of modifications to these devices (if any) so that they can operate as discussed herein will be apparent to persons skilled in the relevant art. In addition, numerous combinatorial libraries are themselves commercially available (see, e.g., ComGenex, Princeton, N.J.; Asinex, Moscow, RU; Tripos, Inc., St. Louis, Mo.; ChemStar, Ltd, Moscow, RU; 3D Pharmaceuticals, Exton, Pa.; Martek Biosciences, Columbia, Md.; etc.).

The term "cytotoxic agent" refers to a substance that inhibits or prevents the expression activity of cells, function of cells and/or causes destruction of cells. The term is intended to include radioactive isotopes chemotherapeutic agents, and toxins such as small molecule toxins or enzymatically active toxins of bacterial, fungal, plant or animal origin, including fragments and/or variants thereof. Examples of cytotoxic agents include, but are not limited to auristatins, auromycins, maytansinoids, yttrium, bismuth, ricin, ricin A-chain, combrestatin, duocarmycins, dolostatins, doxorubicin, daunorubicin, taxol, cisplatin, cc1065, ethidium bromide, mitomycin, etoposide, tenoposide, vincristine, vinblastine, colchicine, dihydroxy anthracin dione, actinomycin, diphtheria toxin, Pseudomonas exotoxin (PE) A, PE40, abrin, abrin A chain, modeccin A chain, alpha-sarcin, gelonin, mitogellin, retstrictocin, phenomycin, enomycin, curicin, crotin, calicheamicin, *Sapaonaria officinalis* inhibitor, and glucocorticoid and other chemotherapeutic agents, as well as radioisotopes such as $At^{211}$, $I^{131}$, $I^{125}$, $Y^{90}$, $Re^{186}$, $Re^{188}$, $Sm^{153}$, $Bi^{212}$ or $^{213}$, $P^{32}$ and radioactive isotopes of Lu including $Lu^{177}$. Antibodies may also be conjugated to an anti-cancer pro-drug activating enzyme capable of converting the pro-drug to its active form.

The "gene product" is sometimes referred to herein as a protein or mRNA. For example, a "gene product of the invention" is sometimes referred to herein as a "cancer amino acid sequence", "cancer protein", "protein of a cancer listed in Table I", a "cancer mRNA", "mRNA of a cancer listed in Table I", etc. In one embodiment, the cancer protein is encoded by a nucleic acid of FIG. 2. The cancer protein can be a fragment, or alternatively, be the full-length protein to the fragment encoded by the nucleic acids of FIG. 2. In one embodiment, a cancer amino acid sequence is used to determine sequence identity or similarity. In another embodiment, the sequences are naturally occurring allelic variants of a protein encoded by a nucleic acid of FIG. 2. In another embodiment, the sequences are sequence variants as further described herein.

"High throughput screening" assays for the presence, absence, quantification, or other properties of particular nucleic acids or protein products are well known to those of skill in the art. Similarly, binding assays and reporter gene assays are similarly well known. Thus, e.g., U.S. Pat. No. 5,559,410 discloses high throughput screening methods for proteins; U.S. Pat. No. 5,585,639 discloses high throughput screening methods for nucleic acid binding (i.e., in arrays); while U.S. Pat. Nos. 5,576,220 and 5,541,061 disclose high throughput methods of screening for ligand/antibody binding.

In addition, high throughput screening systems are commercially available (see, e.g., Amersham Biosciences, Piscataway, N.J.; Zymark Corp., Hopkinton, Mass.; Air Technical Industries, Mentor, Ohio; Beckman Instruments, Inc. Fullerton, Calif.; Precision Systems, Inc., Natick, Mass.; etc.). These systems typically automate entire procedures, including all sample and reagent pipetting, liquid dispensing, timed incubations, and final readings of the microplate in detector (s) appropriate for the assay. These configurable systems provide high throughput and rapid start up as well as a high degree of flexibility and customization. The manufacturers of such systems provide detailed protocols for various high throughput systems. Thus, e.g., Zymark Corp. provides technical bulletins describing screening systems for detecting the modulation of gene transcription, ligand binding, and the like.

The term "homolog" refers to a molecule which exhibits homology to another molecule, by for example, having sequences of chemical residues that are the same or similar at corresponding positions.

"Human Leukocyte Antigen" or "HLA" is a human class I or class II Major Histocompatibility Complex (MHC) protein (see, e.g., Stites, et al., IMMUNOLOGY, $8^{TH}$ ED., Lange Publishing, Los Altos, Calif. (1994).

The terms "hybridize", "hybridizing", "hybridizes" and the like, used in the context of polynucleotides, are meant to refer to conventional hybridization conditions, preferably such as hybridization in 50% formamide/6XSSC/0.1% SDS/100 µg/ml ssDNA, in which temperatures for hybridization are above 37 degrees C. and temperatures for washing in 0.1XSSC/0.1% SDS are above 55 degrees C.

The phrases "isolated" or "biologically pure" refer to material which is substantially or essentially free from components which normally accompany the material as it is found in its native state. Thus, isolated peptides in accordance with the invention preferably do not contain materials normally associated with the peptides in their in situ environment. For example, a polynucleotide is said to be "isolated" when it is substantially separated from contaminant polynucleotides that correspond or are complementary to genes other than the PSCA genes or that encode polypeptides other than PSCA gene product or fragments thereof. A skilled artisan can readily employ nucleic acid isolation procedures to obtain an isolated PSCA polynucleotide. A protein is said to be "isolated," for example, when physical, mechanical or chemical methods are employed to remove the PSCA proteins from cellular constituents that are normally associated with the protein. A skilled artisan can readily employ standard purification methods to obtain an isolated PSCA protein. Alternatively, an isolated protein can be prepared by chemical means.

The term "mammal" refers to any organism classified as a mammal, including mice, rats, rabbits, dogs, cats, cows, horses and humans. In one embodiment of the invention, the mammal is a mouse. In another embodiment of the invention, the mammal is a human.

The terms "metastatic prostate cancer" and "metastatic disease" mean prostate cancers that have spread to regional lymph nodes or to distant sites, and are meant to include stage D disease under the AUA system and stage TxNxM+ under the TNM system. As is the case with locally advanced prostate cancer, surgery is generally not indicated for patients with metastatic disease, and hormonal (androgen ablation) therapy is a preferred treatment modality. Patients with metastatic prostate cancer eventually develop an androgen-refractory state within 12 to 18 months of treatment initiation. Approximately half of these androgen-refractory patients die within 6 months after developing that status. The most common site for prostate cancer metastasis is bone. Prostate cancer bone metastases are often osteoblastic rather than osteolytic (i.e., resulting in net bone formation). Bone metastases are found most frequently in the spine, followed by the femur, pelvis, rib cage, skull and humerus. Other common sites for metastasis include lymph nodes, lung, liver and brain. Metastatic prostate cancer is typically diagnosed by open or laparoscopic pelvic lymphadenectomy, whole body radionuclide scans, skeletal radiography, and/or bone lesion biopsy.

The term "modulator" or "test compound" or "drug candidate" or grammatical equivalents as used herein describe any molecule, e.g., protein, oligopeptide, small organic molecule, polysaccharide, polynucleotide, etc., to be tested for the capacity to directly or indirectly alter the cancer phenotype or the expression of a cancer sequence, e.g., a nucleic acid or protein sequences, or effects of cancer sequences (e.g., signaling, gene expression, protein interaction, etc.) In one aspect, a modulator will neutralize the effect of a cancer protein of the invention. By "neutralize" is meant that an activity of a protein is inhibited or blocked, along with the consequent effect on the cell. In another aspect, a modulator will neutralize the effect of a gene, and its corresponding protein, of the invention by normalizing levels of said protein. In preferred embodiments, modulators alter expression profiles, or expression profile nucleic acids or proteins provided herein, or downstream effector pathways. In one embodiment, the modulator suppresses a cancer phenotype, e.g. to a normal tissue fingerprint. In another embodiment, a modulator induced a cancer phenotype. Generally, a plurality of assay mixtures is run in parallel with different agent concentrations to obtain a differential response to the various concentrations. Typically, one of these concentrations serves as a negative control, i.e., at zero concentration or below the level of detection.

Modulators, drug candidates or test compounds encompass numerous chemical classes, though typically they are organic molecules, preferably small organic compounds having a molecular weight of more than 100 and less than about 2,500 Daltons. Preferred small molecules are less than 2000, or less than 1500 or less than 1000 or less than 500 D. Candidate agents comprise functional groups necessary for structural interaction with proteins, particularly hydrogen bonding, and typically include at least an amine, carbonyl, hydroxyl or carboxyl group, preferably at least two of the functional chemical groups. The candidate agents often comprise cyclical carbon or heterocyclic structures and/or aromatic or polyaromatic structures substituted with one or more of the above functional groups. Modulators also comprise biomolecules such as peptides, saccharides, fatty acids, steroids, purines, pyrimidines, derivatives, structural analogs or combinations thereof. Particularly preferred are peptides. One class of modulators are peptides, for example of from about five to about 35 amino acids, with from about five to about 20 amino acids being preferred, and from about 7 to about 15 being particularly preferred. Preferably, the cancer modulatory protein is soluble, includes a non-transmembrane region, and/or, has an N-terminal Cys to aid in solubility. In one embodiment, the C-terminus of the fragment is kept as a free acid and the N-terminus is a free amine to aid in coupling, i.e., to cysteine. In one embodiment, a cancer protein of the invention is conjugated to an immunogenic agent as discussed herein. In one embodiment, the cancer protein is conjugated to BSA. The peptides of the invention, e.g., of preferred lengths, can be linked to each other or to other amino acids to create a longer peptide/protein. The modulatory peptides can be digests of naturally occurring proteins as is outlined above, random peptides, or "biased" random peptides. In a preferred embodiment, peptide/protein-based modulators are antibodies, and fragments thereof, as defined herein.

Modulators of cancer can also be nucleic acids. Nucleic acid modulating agents can be naturally occurring nucleic acids, random nucleic acids, or "biased" random nucleic acids. For example, digests of prokaryotic or eukaryotic genomes can be used in an approach analogous to that outlined above for proteins.

The term "monoclonal antibody" refers to an antibody obtained from a population of substantially homogeneous antibodies, i.e., the antibodies comprising the population are identical except for possible naturally occurring mutations that are present in minor amounts.

A "motif", as in biological motif of a PSCA-related protein, refers to any pattern of amino acids forming part of the primary sequence of a protein, that is associated with a particular function (e.g. protein-protein interaction, protein-DNA interaction, etc) or modification (e.g. that is phosphorylated, glycosylated or amidated), or localization (e.g. secretory sequence, nuclear localization sequence, etc.) or a sequence that is correlated with being immunogenic, either humorally or cellularly. A motif can be either contiguous or capable of being aligned to certain positions that are generally correlated with a certain function or property. In the context of HLA motifs, "motif" refers to the pattern of residues in a peptide of defined length, usually a peptide of from about 8 to about 13 amino acids for a class I HLA motif and from about 6 to about 25 amino acids for a class II HLA motif, which is recognized by a particular HLA molecule. Peptide motifs for HLA binding are typically different for each protein encoded by each human HLA allele and differ in the pattern of the primary and secondary anchor residues.

A "pharmaceutical excipient" comprises a material such as an adjuvant, a carrier, pH-adjusting and buffering agents, tonicity adjusting agents, wetting agents, preservative, and the like.

"Pharmaceutically acceptable" refers to a non-toxic, inert, and/or composition that is physiologically compatible with humans or other mammals.

The term "polynucleotide" means a polymeric form of nucleotides of at least 10 bases or base pairs in length, either ribonucleotides or deoxynucleotides or a modified form of either type of nucleotide, and is meant to include single and double stranded forms of DNA and/or RNA. In the art, this term if often used interchangeably with "oligonucleotide". A polynucleotide can comprise a nucleotide sequence disclosed herein wherein thymidine (T), as shown for example in FIG. 2, can also be uracil (U); this definition pertains to the differences between the chemical structures of DNA and RNA, in particular the observation that one of the four major bases in RNA is uracil (U) instead of thymidine (T).

The term "polypeptide" means a polymer of at least about 4, 5, 6, 7, or 8 amino acids. Throughout the specification, standard three letter or single letter designations for amino acids are used. In the art, this term is often used interchangeably with "peptide" or "protein".

An HLA "primary anchor residue" is an amino acid at a specific position along a peptide sequence which is understood to provide a contact point between the immunogenic peptide and the HLA molecule. One to three, usually two, primary anchor residues within a peptide of defined length generally defines a "motif" for an immunogenic peptide. These residues are understood to fit in close contact with peptide binding groove of an HLA molecule, with their side chains buried in specific pockets of the binding groove. In one embodiment, for example, the primary anchor residues for an HLA class I molecule are located at position 2 (from the amino terminal position) and at the carboxyl terminal position of a 8, 9, 10, 11, or 12 residue peptide epitope in accordance with the invention. Alternatively, in another embodiment, the primary anchor residues of a peptide binds an HLA class II molecule are spaced relative to each other, rather than to the termini of a peptide, where the peptide is generally of at least 9 amino acids in length. The primary anchor positions for each motif and supermotif are set forth in Table IV. For example, analog peptides can be created by altering the presence or absence of particular residues in the primary and/or secondary anchor positions shown in Table IV. Such analogs are used to modulate the binding affinity and/or population coverage of a peptide comprising a particular HLA motif or supermotif.

"Radioisotopes" include, but are not limited to the following (non-limiting exemplary uses are also set forth):

**Examples of Medical Isotopes:

| Isotope | Description of use |
| --- | --- |
| Actinium-225 (AC-225) | See Thorium-229 (Th-229) |
| Actinium-227 (AC-227) | Parent of Radium-223 (Ra-223) which is an alpha emitter used to treat metastases in the skeleton resulting from cancer (i.e., breast and prostate cancers), and cancer radioimmunotherapy |
| Bismuth-212 (Bi-212) | See Thorium-228 (Th-228) |
| Bismuth-213 (Bi-213) | See Thorium-229 (Th-229) |
| Cadmium-109 (Cd-109) | Cancer detection |
| Cobalt-60 (Co-60) | Radiation source for radiotherapy of cancer, for food irradiators, and for sterilization of medical supplies |
| Copper-64 (Cu-64) | A positron emitter used for cancer therapy and SPECT imaging |
| Copper-67 (Cu-67) | Beta/gamma emitter used in cancer radioimmunotherapy and diagnostic studies (i.e., breast and colon cancers, and lymphoma) |
| Dysprosium-166 (Dy-166) | Cancer radioimmunotherapy |
| Erbium-169 (Er-169) | Rheumatoid arthritis treatment, particularly for the small joints associated with fingers and toes |
| Europium-152 (Eu-152) | Radiation source for food irradiation and for sterilization of medical supplies |
| Europium-154 (Eu-154) | Radiation source for food irradiation and for sterilization of medical supplies |
| Gadolinium-153 (Gd-153) | Osteoporosis detection and nuclear medical quality assurance devices |
| Gold-198 (Au-198) | Implant and intracavity therapy of ovarian, prostate, and brain cancers |
| Holmium-166 (Ho-166) | Multiple myeloma treatment in targeted skeletal therapy, cancer radioimmunotherapy, bone marrow ablation, and rheumatoid arthritis treatment |
| Iodine-125 (I-125) | Osteoporosis detection, diagnostic imaging, tracer drugs, brain cancer treatment, radiolabeling, tumor imaging, mapping of receptors in the brain, interstitial radiation therapy, brachytherapy for treatment of prostate cancer, determination of glomerular filtration rate (GFR), determination of plasma volume, detection of deep vein thrombosis of the legs |
| Iodine-131 (I-131) | Thyroid function evaluation, thyroid disease detection, treatment of thyroid cancer as well as other non-malignant thyroid diseases (i.e., Graves disease, goiters, and hyperthyroidism), treatment of leukemia, lymphoma, and other forms of cancer (e.g., breast cancer) using radioimmunotherapy |
| Iridium-192 | Brachytherapy, brain and spinal cord tumor treatment, treatment of blocked arteries (i.e., |

-continued

| Isotope | Description of use |
|---|---|
| (Ir-192) | arteriosclerosis and restenosis), and implants for breast and prostate tumors |
| Lutetium-177 (Lu-177) | Cancer radioimmunotherapy and treatment of blocked arteries (i.e., arteriosclerosis and restenosis) |
| Molybdenum-99 (Mo-99) | Parent of Technetium-99m (Tc-99m) which is used for imaging the brain, liver, lungs, heart, and other organs. Currently, Tc-99m is the most widely used radioisotope used for diagnostic imaging of various cancers and diseases involving the brain, heart, liver, lungs; also used in detection of deep vein thrombosis of the legs |
| Osmium-194 (Os-194) | Cancer radioimmunotherapy |
| Palladium-103 (Pd-103) | Prostate cancer treatment |
| Platinum-195m (Pt-195m) | Studies on biodistribution and metabolism of cisplatin, a chemotherapeutic drug |
| Phosphorus-32 (P-32) | Polycythemia rubra vera (blood cell disease) and leukemia treatment, bone cancer diagnosis/treatment; colon, pancreatic, and liver cancer treatment; radiolabeling nucleic acids for in vitro research, diagnosis of superficial tumors, treatment of blocked arteries (i.e., arteriosclerosis and restenosis), and intracavity therapy |
| Phosphorus-33 (P-33) | Leukemia treatment, bone disease diagnosis/treatment, radiolabeling, and treatment of blocked arteries (i.e., arteriosclerosis and restenosis) |
| Radium-223 (Ra-223) | See Actinium-227 (Ac-227) |
| Rhenium-186 (Re-186) | Bone cancer pain relief, rheumatoid arthritis treatment, and diagnosis and treatment of lymphoma and bone, breast, colon, and liver cancers using radioimmunotherapy |
| Rhenium-188 (Re-188) | Cancer diagnosis and treatment using radioimmunotherapy, bone cancer pain relief, treatment of rheumatoid arthritis, and treatment of prostate cancer |
| Rhodium-105 (Rh-105) | Cancer radioimmunotherapy |
| Samarium-145 (Sm-145) | Ocular cancer treatment |
| Samarium-153 (Sm-153) | Cancer radioimmunotherapy and bone cancer pain relief |
| Scandium-47 (Sc-47) | Cancer radioimmunotherapy and bone cancer pain relief |
| Selenium-75 (Se-75) | Radiotracer used in brain studies, imaging of adrenal cortex by gamma-scintigraphy, lateral locations of steroid secreting tumors, pancreatic scanning, detection of hyperactive parathyroid glands, measure rate of bile acid loss from the endogenous pool |
| Strontium-85 (Sr-85) | Bone cancer detection and brain scans |
| Strontium-89 (Sr-89) | Bone cancer pain relief, multiple myeloma treatment, and osteoblastic therapy |
| Technetium-99m (Tc-99m) | See Molybdenum-99 (Mo-99) |
| Thorium-228 (Th-228) | Parent of Bismuth-212 (Bi-212) which is an alpha emitter used in cancer radioimmunotherapy |
| Thorium-229 (Th-229) | Parent of Actinium-225 (Ac-225) and grandparent of Bismuth-213 (Bi-213) which are alpha emitters used in cancer radioimmunotherapy |
| Thulium-170 (Tm-170) | Gamma source for blood irradiators, energy source for implanted medical devices |
| Tin-117m (Sn-117m) | Cancer immunotherapy and bone cancer pain relief |
| Tungsten-188 (W-188) | Parent for Rhenium-188 (Re-188) which is used for cancer diagnostics/treatment, bone cancer pain relief, rheumatoid arthritis treatment, and treatment of blocked arteries (i.e., arteriosclerosis and restenosis) |
| Xenon-127 (Xe-127) | Neuroimaging of brain disorders, high resolution SPECT studies, pulmonary function tests, and cerebral blood flow studies |
| Ytterbium-175 (Yb-175) | Cancer radioimmunotherapy |
| Yttrium-90 (Y-90) | Microseeds obtained from irradiating Yttrium-89 (Y-89) for liver cancer treatment |
| Yttrium-91 (Y-91) | A gamma-emitting label for Yttrium-90 (Y-90) which is used for cancer radioimmunotherapy (i.e., lymphoma, breast, colon, kidney, lung, ovarian, prostate, pancreatic, and inoperable liver cancers) |

By "randomized" or grammatical equivalents as herein applied to nucleic acids and proteins is meant that each nucleic acid and peptide consists of essentially random nucleotides and amino acids, respectively. These random peptides (or nucleic acids, discussed herein) can incorporate any nucleotide or amino acid at any position. The synthetic process can be designed to generate randomized proteins or nucleic acids, to allow the formation of all or most of the possible combinations over the length of the sequence, thus forming a library of randomized candidate bioactive proteinaceous agents.

In one embodiment, a library is "fully randomized," with no sequence preferences or constants at any position. In another embodiment, the library is a "biased random" library. That is, some positions within the sequence either are held constant, or are selected from a limited number of possibilities. For example, the nucleotides or amino acid residues are randomized within a defined class, e.g., of hydrophobic amino acids, hydrophilic residues, sterically biased (either small or large) residues, towards the creation of nucleic acid binding domains, the creation of cysteines, for cross-linking, prolines for SH-3 domains, serines, threonines, tyrosines or histidines for phosphorylation sites, etc., or to purines, etc.

A "recombinant" DNA or RNA molecule is a DNA or RNA molecule that has been subjected to molecular manipulation in vitro.

Non-limiting examples of small molecules include compounds that bind or interact with PSCA, ligands including hormones, neuropeptides, chemokines, odorants, phospholipids, and functional equivalents thereof that bind and preferably inhibit PSCA protein function. Such non-limiting small molecules preferably have a molecular weight of less than about 10 kDa, more preferably below about 9, about 8, about 7, about 6, about 5 or about 4 kDa. In certain embodiments, small molecules physically associate with, or bind, PSCA protein; are not found in naturally occurring metabolic pathways; and/or are more soluble in aqueous than non-aqueous solutions "Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured nucleic acid sequences to reanneal when complementary strands are present in an environment below their melting temperature. The higher the degree of desired homology between the probe and hybridizable sequence, the higher the relative temperature that can be used. As a result, it follows that higher relative temperatures would tend to make the reaction conditions more stringent, while lower temperatures less so. For additional details and explanation of stringency of hybridization reactions, see Ausubel et al., Current Protocols in Molecular Biology, Wiley Interscience Publishers, (1995).

"Stringent conditions" or "high stringency conditions", as defined herein, are identified by, but not limited to, those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 µg/ml), 0.1% SDS, and 10% dextran sulfate at 42° C., with washes at 42° C. in 0.2×SSC (sodium chloride/sodium. citrate) and 50% formamide at 55° C., followed by a high-stringency wash consisting of 0.1×SSC containing EDTA at 55° C. "Moderately stringent conditions" are described by, but not limited to, those in Sambrook et al., Molecular Cloning: A Laboratory Manual, New York: Cold Spring Harbor Press, 1989, and include the use of washing solution and hybridization conditions (e.g., temperature, ionic strength and % SDS) less stringent than those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5×Denhardt's solution, 10% dextran sulfate, and 20 mg/mL denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

An HLA "supermotif" is a peptide binding specificity shared by HLA molecules encoded by two or more HLA alleles. Overall phenotypic frequencies of HLA-supertypes in different ethnic populations are set forth in Table IV (F). The non-limiting constituents of various supetypes are as follows:
  A2: A*0201, A*0202, A*0203, A*0204, A*0205, A*0206, A*6802, A*6901, A*0207
  A3: A3, A11, A31, A*3301, A*6801, A*0301, A*1101, A*3101
  B7: B7, B*3501-03, B*51, B*5301, B*5401, B*5501, B*5502, B*5601, B*6701, B*7801, B*0702, B*5101, B*5602
  B44: B*3701, B*4402, B*4403, B*60 (B*4001), B61 (B*4006)
  A1: A*0102, A*2604, A*3601, A*4301, A*8001
  A24: A*24, A*30, A*2403, A*2404, A*3002, A*3003
  B27: B*1401-02, B*1503, B*1509, B*1510, B*1518, B*3801-02, B*3901, B*3902, B*3903-04, B*4801-02, B*7301, B*2701-08
  B58: B*1516, B*1517, B*5701, B*5702, B58
  B62: B*4601, B52, B*1501 (B62), B*1502 (B75), B*1513 (B77)

Calculated population coverage afforded by different HLA-supertype combinations are set forth in Table IV (G).

As used herein "to treat" or "therapeutic" and grammatically related terms, refer to any improvement of any consequence of disease, such as prolonged survival, less morbidity, and/or a lessening of side effects which are the byproducts of an alternative therapeutic modality; full eradication of disease is not required.

A "transgenic animal" (e.g., a mouse or rat) is an animal having cells that contain a transgene, which transgene was introduced into the animal or an ancestor of the animal at a prenatal, e.g., an embryonic stage. A "transgene" is a DNA that is integrated into the genome of a cell from which a transgenic animal develops.

As used herein, an HLA or cellular immune response "vaccine" is a composition that contains or encodes one or more peptides of the invention. There are numerous embodiments of such vaccines, such as a cocktail of one or more individual peptides; one or more peptides of the invention comprised by a polyepitopic peptide; or nucleic acids that encode such individual peptides or polypeptides, e.g., a minigene that encodes a polyepitopic peptide. The "one or more peptides" can include any whole unit integer from 1-150 or more, e.g., at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, 100, 105, 110, 115, 120, 125, 130, 135, 140, 145, or 150 or more peptides of the invention. The peptides or polypeptides can optionally be modified, such as by lipidation, addition of targeting or other sequences. HLA class I peptides of the invention can be admixed with, or linked to, HLA class II peptides, to facilitate activation of both cytotoxic T lymphocytes and helper T lymphocytes. HLA vaccines can also comprise peptide-pulsed antigen presenting cells, e.g., dendritic cells.

Figures 2, 11B:
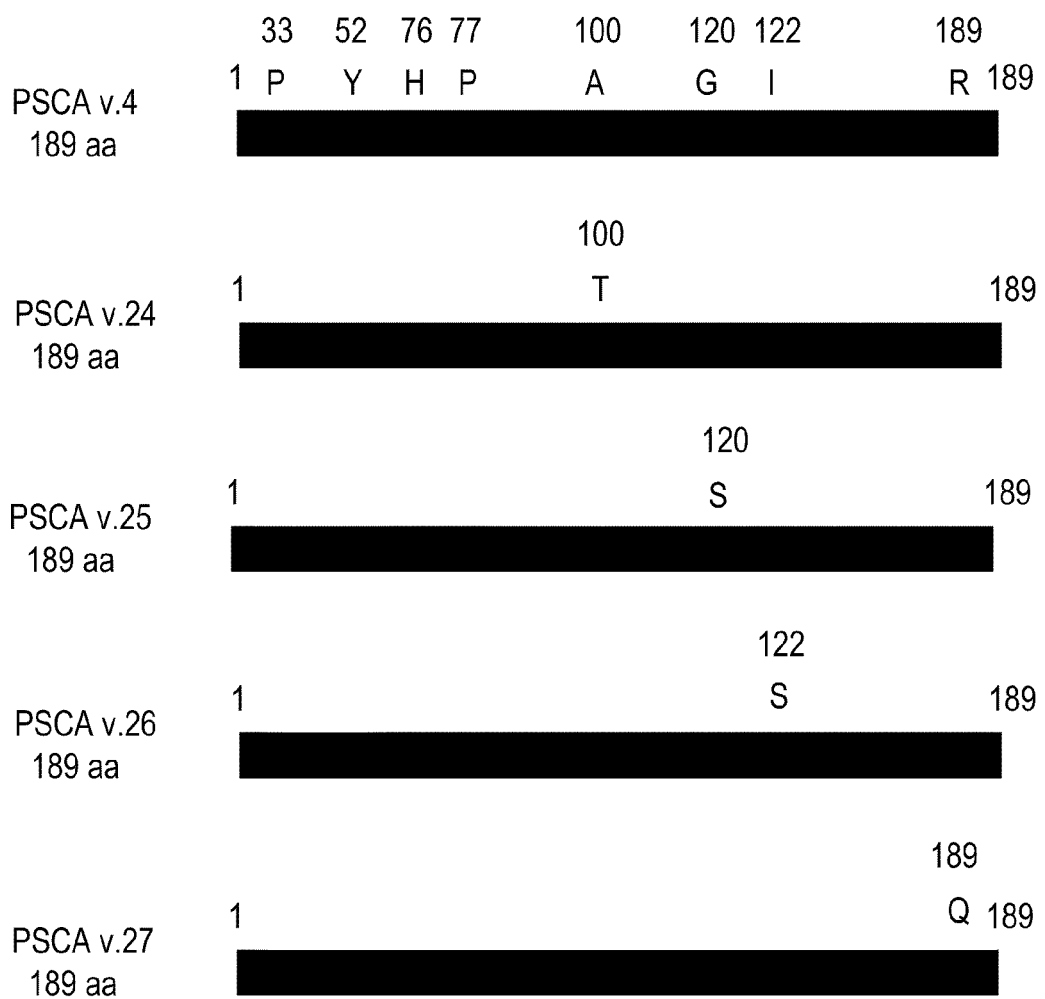
FIG. 2. A) The cDNA and amino acid sequence of PSCA variant 1 (also called "PSCA v.1" or "PSCA variant 1") is shown in FIG. 2A. The start methionine is underlined. The open reading frame extends from nucleic acid 18-389 including the stop codon.

The term "variant" refers to a molecule that exhibits a variation from a described type or norm, such as a protein that has one or more different amino acid residues in the corresponding position(s) of a specifically described protein (e.g. the PSCA protein shown in FIG. 2 or FIG. 3. An analog is an example of a variant protein. Splice isoforms and single nucleotides polymorphisms (SNPs) are further examples of variants.

The "PSCA-related proteins" of the invention include those specifically identified herein, as well as allelic variants, conservative substitution variants, analogs and homologs that can be isolated/generated and characterized without undue experimentation following the methods outlined herein or readily available in the art. Fusion proteins that combine parts of different PSCA proteins or fragments thereof, as well as fusion proteins of a PSCA protein and a heterologous polypeptide are also included. Such PSCA proteins are collectively referred to as the PSCA-related proteins, the proteins of the invention, or PSCA. The term "PSCA-related protein" refers to a polypeptide fragment or a PSCA protein sequence of 4, 5, 6, 7, 8, 9, 10, 11, 12, 13, 14, 15, 16, 17, 18, 19, 20, 21, 22, 23, 24, 25, or more than 25 amino acids; or, at least 30, 35, 40, 45, 50, 55, 60, 65, 70, 80, 85, 90, 95, 100, 105, 110, 115, 120, 125, 130, 135, 140, 145, 150, 155, 160, 165, 170, 175, 180, 185, 190, 195, 200, 225, 250, 275, 300, 325, 350, 375, 400, 425, 450, 475, 500, 525, 550, 575, or 576 or more amino acids.

II.) PSCA Polynucleotides

One aspect of the invention provides polynucleotides corresponding or complementary to all or part of a PSCA gene, mRNA, and/or coding sequence, preferably in isolated form, including polynucleotides encoding a PSCA-related protein and fragments thereof, DNA, RNA, DNA/RNA hybrid, and related molecules, polynucleotides or oligonucleotides complementary to a PSCA gene or mRNA sequence or a part thereof, and polynucleotides or oligonucleotides that hybridize to a PSCA gene, mRNA, or to a PSCA encoding polynucleotide (collectively, "PSCA polynucleotides"). In all instances when referred to in this section, T can also be U in FIG. 2.

Embodiments of a PSCA polynucleotide include: a PSCA polynucleotide having the sequence shown in FIG. 2, the nucleotide sequence of PSCA as shown in FIG. 2 wherein T is U; at least 10 contiguous nucleotides of a polynucleotide having the sequence as shown in FIG. 2; or, at least 10 contiguous nucleotides of a polynucleotide having the sequence as shown in FIG. 2 where T is U. For example, embodiments of PSCA nucleotides comprise, without limitation:

(I) a polynucleotide comprising, consisting essentially of, or consisting of a sequence as shown in FIG. 2, wherein T can also be U;

(II) a polynucleotide comprising, consisting essentially of, or consisting of the sequence as shown in FIG. 2A, from nucleotide residue number 18 through nucleotide residue number 389, including the stop codon, wherein T can also be U;

(III) a polynucleotide comprising, consisting essentially of, or consisting of the sequence as shown in FIG. 2B, from nucleotide residue number 56 through nucleotide residue number 427, including the stop codon, wherein T can also be U;

(IV) a polynucleotide comprising, consisting essentially of, or consisting of the sequence as shown in FIG. 2C, from nucleotide residue number 423 through nucleotide residue number 707, including the a stop codon, wherein T can also be U;

(V) a polynucleotide comprising, consisting essentially of, or consisting of the sequence as shown in FIG. 2D, from nucleotide residue number 424 through nucleotide residue number 993, including the stop codon, wherein T can also be U;

(VI) a polynucleotide comprising, consisting essentially of, or consisting of the sequence as shown in FIG. 2E, from nucleotide residue number 910 through nucleotide residue number 1479, including the stop codon, wherein T can also be U;

(VII) a polynucleotide comprising, consisting essentially of, or consisting of the sequence as shown in FIG. 2F, from nucleotide residue number 83 through nucleotide residue number 427, including the stop codon, wherein T can also be U;

(VIII) a polynucleotide comprising, consisting essentially of, or consisting of the sequence as shown in FIG. 2G, from nucleotide residue number 56 through nucleotide residue number 427, including the stop codon, wherein T can also be U;

(IX) a polynucleotide comprising, consisting essentially of, or consisting of the sequence as shown in FIG. 2H, from nucleotide residue number 424 through nucleotide residue number 993, including the stop codon, wherein T can also be U;

(X) a polynucleotide that encodes a PSCA-related protein that is at least 90, 91, 92, 93, 94, 95, 96, 97, 98, 99 or 100% homologous to an entire amino acid sequence shown in FIG. 2A-H;

(XI) a polynucleotide that encodes a PSCA-related protein that is at least 90, 91, 92, 93, 94, 95, 96, 97, 98, 99 or 100% identical to an entire amino acid sequence shown in FIG. 2A-H;

(XII) polynucleotide that encodes at least one peptide set forth in Tables VIII-XXI and XXII-XLIX;

(XIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3A in any whole number increment up to 123 that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XIV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3A in any whole number increment up to 123 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3A in any whole number increment up to 123 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XVI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3A in any whole number increment up to 123 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XVII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3A in any whole number increment up to 123 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XVIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3B in any whole number increment up to 94 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XIX) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3B in any whole number increment up to 94 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XX) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3B in any whole number increment up to 94 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XXI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3B in any whole number increment up to 94 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XXII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3B in any whole number increment up to 94 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XXIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3C, 3E-3L in any whole number increment up to 189 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5

(XXIV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3C, 3E-3L in any whole number increment up to 189 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XXV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3C, 3E-3L in any whole number increment up to 189 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XXVI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3C, 3E-3L in any whole number increment up to 189 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XXVII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3C, 3E-3L in any whole number increment up to 189 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XXVIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3D in any whole number increment up to 114 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5

(XXIX) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3D in any whole number increment up to 114 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XXX) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3D in any whole number increment up to 114 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XXXI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3D in any whole number increment up to 114 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XXXII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3D in any whole number increment up to 114 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XXXIII) a polynucleotide that is fully complementary to a polynucleotide of any one of (I)-(XXXII).

(XXXIV) a peptide that is encoded by any of (I) to (XXXIII); and;

(XXXV) a composition comprising a polynucleotide of any of (I)-(XXXIII) or peptide of (XXXIV) together with a pharmaceutical excipient and/or in a human unit dose form;

(XXXVI) a method of using a polynucleotide of any (I)-(XXXIII) or peptide of (XXXIV) or a composition of (XXXV) in a method to modulate a cell expressing PSCA;

(XXXVII) a method of using a polynucleotide of any (I)-(XXXIII) or peptide of (XXXIV) or a composition of (XXXV) in a method to diagnose, prophylax, prognose, or treat an individual who bears a cell expressing PSCA;

(XXXVIII) a method of using a polynucleotide of any (I)-(XXXIII) or peptide of (XXXIV) or a composition of (XXXV) in a method to diagnose, prophylax, prognose, or treat an individual who bears a cell expressing PSCA, said cell from a cancer of a tissue listed in Table I (XXXIX) a method of using a polynucleotide of any (I)-(XXXIII) or peptide of (XXXIV) or a composition of (XXXV) in a method to diagnose, prophylax, prognose, or treat a a cancer (XL) a method of using a polynucleotide of any (I)-(XXXIII) or peptide of (XXXIV) or a composition of (XXXV) in a method to diagnose, prophylax, prognose, or treat a a cancer of a tissue listed in Table I; and, (XLI) a method of using a polynucleotide of any (I)-(XXXIII) or peptide of (XXXIV) or a composition of (XXXV) in a method to identify or characterize a modulator of a cell expressing PSCA.

As used herein, a range is understood to disclose specifically all whole unit positions thereof.

Typical embodiments of the invention disclosed herein include PSCA polynucleotides that encode specific portions of PSCA mRNA sequences (and those which are complementary to such sequences) such as those that encode the proteins and/or fragments thereof, for example:

(a) 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, and 123 or more contiguous amino acids of PSCA variant 1; the maximal lengths relevant for other variants are: variant 3, 94 amino acids; variant 4, 189 amino acids, variant 6, 114 amino acids, variant 19, 189 amino acids, variant 20, 189 amoni acids, variant 21, 189 amino acids, variant 22, 189 amino acids, variant 24, 189 amino acids, variant 25, 189 amino acids, variant 26, 189 amino acids, and variant 27, 189 amino acids.

For example, representative embodiments of the invention disclosed herein include: polynucleotides and their encoded peptides themselves encoding about amino acid 1 to about amino acid 10 of the PSCA protein shown in FIG. 2 or FIG. 3, polynucleotides encoding about amino acid 10 to about amino acid 20 of the PSCA protein shown in FIG. 2 or FIG. 3, polynucleotides encoding about amino acid 20 to about amino acid 30 of the PSCA protein shown in FIG. 2 or FIG. 3, polynucleotides encoding about amino acid 30 to about amino acid 40 of the PSCA protein shown in FIG. 2 or FIG. 3, polynucleotides encoding about amino acid 40 to about amino acid 50 of the PSCA protein shown in FIG. 2 or FIG. 3, polynucleotides encoding about amino acid 50 to about amino acid 60 of the PSCA protein shown in FIG. 2 or FIG. 3, polynucleotides encoding about amino acid 60 to about amino acid 70 of the PSCA protein shown in FIG. 2 or FIG. 3, polynucleotides encoding about amino acid 70 to about amino acid 80 of the PSCA protein shown in FIG. 2 or FIG. 3, polynucleotides encoding about amino acid 80 to about amino acid 90 of the PSCA protein shown in FIG. 2 or FIG. 3, polynucleotides encoding about amino acid 90 to about amino acid 100 of the PSCA protein shown in FIG. 2 or FIG. 3, in increments of about 10 amino acids, ending at the carboxyl terminal amino acid set forth in FIG. 2 or FIG. 3. Accordingly, polynucleotides encoding portions of the amino acid sequence (of about 10 amino acids), of amino acids, 100 through the carboxyl terminal amino acid of the PSCA protein are embodiments of the invention. Wherein it is understood that each particular amino acid position discloses that position plus or minus five amino acid residues.

Polynucleotides encoding relatively long portions of a PSCA protein are also within the scope of the invention. For example, polynucleotides encoding from about amino acid 1 (or 20 or 30 or 40 etc.) to about amino acid 20, (or 30, or 40 or 50 etc.) of the PSCA protein "or variant" shown in FIG. 2 or FIG. 3 can be generated by a variety of techniques well known in the art. These polynucleotide fragments can include any portion of the PSCA sequence as shown in FIG. 2.

Additional illustrative embodiments of the invention disclosed herein include PSCA polynucleotide fragments encoding one or more of the biological motifs contained within a PSCA protein "or variant" sequence, including one or more of the motif-bearing subsequences of a PSCA protein "or variant" set forth in Tables VIII-XXI and XXII-XLIX. In another embodiment, typical polynucleotide fragments of the invention encode one or more of the regions of PSCA protein or variant that exhibit homology to a known molecule. In another embodiment of the invention, typical polynucleotide fragments can encode one or more of the PSCA protein or variant N-glycosylation sites, cAMP and cGMP-dependent protein kinase phosphorylation sites, casein kinase II phosphorylation sites or N-myristoylation site and amidation sites.

Note that to determine the starting position of any peptide set forth in Tables VIII-XXI and Tables XXII to XLIX (collectively HLA Peptide Tables) respective to its parental protein, e.g., variant 1, variant 2, etc., reference is made to three factors: the particular variant, the length of the peptide in an HLA Peptide Table, and the Search Peptides listed in Table VII. Generally, a unique Search Peptide is used to obtain HLA peptides for a particular variant. The position of each Search Peptide relative to its respective parent molecule is listed in Table VII. Accordingly, if a Search Peptide begins at position "X", one must add the value "X minus 1" to each position in Tables VIII-XXI and Tables XXII-IL to obtain the actual position of the HLA peptides in their parental molecule. For example if a particular Search Peptide begins at position 150 of its parental molecule, one must add 150–1, i.e., 149 to each HLA peptide amino acid position to calculate the position of that amino acid in the parent molecule.

II.A.) Uses of PSCA Polynucleotides

II.A.1.) Monitoring of Genetic Abnormalities

The polynucleotides of the preceding paragraphs have a number of different specific uses. The human PSCA gene maps to the chromosomal location set forth in the Example entitled "Chromosomal Mapping of PSCA." For example, because the PSCA gene maps to this chromosome, polynucleotides that encode different regions of the PSCA proteins are used to characterize cytogenetic abnormalities of this chromosomal locale, such as abnormalities that are identified as being associated with various cancers. In certain genes, a variety of chromosomal abnormalities including rearrangements have been identified as frequent cytogenetic abnormalities in a number of different cancers (see e.g. Krajinovic et al., Mutat. Res. 382(3-4): 81-83 (1998); Johansson et al., Blood 86(10): 3905-3914 (1995) and Finger et al., P.N.A.S. 85(23): 9158-9162 (1988)). Thus, polynucleotides encoding specific regions of the PSCA proteins provide new tools that can be used to delineate, with greater precision than previously possible, cytogenetic abnormalities in the chromosomal region that encodes PSCA that may contribute to the malignant phenotype. In this context, these polynucleotides satisfy a need in the art for expanding the sensitivity of chromosomal screening in order to identify more subtle and less common chromosomal abnormalities (see e.g. Evans et al., Am. J. Obstet. Gynecol 171(4): 1055-1057 (1994)).

Furthermore, as PSCA was shown to be highly expressed in prostate and other cancers, PSCA polynucleotides are used in methods assessing the status of PSCA gene products in normal versus cancerous tissues. Typically, polynucleotides that encode specific regions of the PSCA proteins are used to assess the presence of perturbations (such as deletions, insertions, point mutations, or alterations resulting in a loss of an antigen etc.) in specific regions of the PSCA gene, such as regions containing one or more motifs. Exemplary assays include both RT-PCR assays as well as single-strand conformation polymorphism (SSCP) analysis (see, e.g., Marrogi et al., J. Cutan. Pathol. 26(8): 369-378 (1999), both of which utilize polynucleotides encoding specific regions of a protein to examine these regions within the protein.

II.A.2.) Antisense Embodiments

Other specifically contemplated nucleic acid related embodiments of the invention disclosed herein are genomic DNA, cDNAs, ribozymes, and antisense molecules, as well as nucleic acid molecules based on an alternative backbone, or including alternative bases, whether derived from natural sources or synthesized, and include molecules capable of inhibiting the RNA or protein expression of PSCA. For example, antisense molecules can be RNAs or other molecules, including peptide nucleic acids (PNAs) or non-nucleic acid molecules such as phosphorothioate derivatives that specifically bind DNA or RNA in a base pair-dependent manner. A skilled artisan can readily obtain these classes of nucleic acid molecules using the PSCA polynucleotides and polynucleotide sequences disclosed herein.

Antisense technology entails the administration of exogenous oligonucleotides that bind to a target polynucleotide located within the cells. The term "antisense" refers to the fact that such oligonucleotides are complementary to their intracellular targets, e.g., PSCA. See for example, Jack Cohen, Oligodeoxynucleotides, Antisense Inhibitors of Gene Expression, CRC Press, 1989; and Synthesis 1:1-5 (1988). The PSCA antisense oligonucleotides of the present invention include derivatives such as S-oligonucleotides (phosphorothioate derivatives or S-oligos, see, Jack Cohen, supra), which exhibit enhanced cancer cell growth inhibitory action. S-oligos (nucleoside phosphorothioates) are isoelectronic analogs of an oligonucleotide (O-oligo) in which a nonbridging oxygen atom of the phosphate group is replaced by a sulfur atom. The S-oligos of the present invention can be prepared by treatment of the corresponding O-oligos with 3H-1,2-benzodithiol-3-one-1,1-dioxide, which is a sulfur transfer reagent. See, e.g., Iyer, R. P. et al., J. Org. Chem. 55:4693-4698 (1990); and Iyer, R. P. et al., J. Am. Chem. Soc. 112:1253-1254 (1990). Additional PSCA antisense oligonucleotides of the present invention include morpholino antisense oligonucleotides known in the art (see, e.g., Partridge et al., 1996, Antisense & Nucleic Acid Drug Development 6: 169-175).

The PSCA antisense oligonucleotides of the present invention typically can be RNA or DNA that is complementary to and stably hybridizes with the first 100 5' codons or last 100 340 codons of a PSCA genomic sequence or the corresponding mRNA. Absolute complementarity is not required, although high degrees of complementarity are preferred. Use of an oligonucleotide complementary to this region allows for the selective hybridization to PSCA mRNA and not to mRNA specifying other regulatory subunits of protein kinase. In one embodiment, PSCA antisense oligonucleotides of the present invention are 15 to 30-mer fragments of the antisense DNA molecule that have a sequence that hybridizes to PSCA mRNA. Optionally, PSCA antisense oligonucleotide is a 30-mer oligonucleotide that is complementary to a region in the first 10 5' codons or last 10 3' codons of PSCA. Alternatively, the antisense molecules are modified to employ ribozymes in the inhibition of PSCA expression, see, e.g., L. A. Couture & D. T. Stinchcomb; Trends Genet 12: 510-515 (1996).

II.A.3.) Primers and Primer Pairs

Further specific embodiments of these nucleotides of the invention include primers and primer pairs, which allow the specific amplification of polynucleotides of the invention or of any specific parts thereof, and probes that selectively or specifically hybridize to nucleic acid molecules of the invention or to any part thereof. Probes can be labeled with a detectable marker, such as, for example, a radioisotope, fluorescent compound, bioluminescent compound, a chemiluminescent compound, metal chelator or enzyme. Such probes and primers are used to detect the presence of a PSCA polynucleotide in a sample and as a means for detecting a cell expressing a PSCA protein.

Examples of such probes include polypeptides comprising all or part of the human PSCA cDNA sequence shown in FIG. 2. Examples of primer pairs capable of specifically amplifying PSCA mRNAs are also described in the Examples. As will be understood by the skilled artisan, a great many different primers and probes can be prepared based on the sequences provided herein and used effectively to amplify and/or detect a PSCA mRNA.

The PSCA polynucleotides of the invention are useful for a variety of purposes, including but not limited to their use as probes and primers for the amplification and/or detection of the PSCA gene(s), mRNA(s), or fragments thereof; as reagents for the diagnosis and/or prognosis of prostate cancer and other cancers; as coding sequences capable of directing the expression of PSCA polypeptides; as tools for modulating or inhibiting the expression of the PSCA gene(s) and/or translation of the PSCA transcript(s); and as therapeutic agents.

The present invention includes the use of any probe as described herein to identify and isolate a PSCA or PSCA related nucleic acid sequence from a naturally occurring source, such as humans or other mammals, as well as the isolated nucleic acid sequence per se, which would comprise all or most of the sequences found in the probe used.

II.A.4.) Isolation of PSCA-Encoding Nucleic Acid Molecules

The PSCA cDNA sequences described herein enable the isolation of other polynucleotides encoding PSCA gene product(s), as well as the isolation of polynucleotides encoding PSCA gene product homologs, alternatively spliced isoforms, allelic variants, and mutant forms of a PSCA gene product as well as polynucleotides that encode analogs of PSCA-related proteins. Various molecular cloning methods that can be employed to isolate full length cDNAs encoding a PSCA gene are well known (see, for example, Sambrook, J. et al., Molecular Cloning: A Laboratory Manual, 2d edition, Cold Spring Harbor Press, New York, 1989; Current Protocols in Molecular Biology. Ausubel et al., Eds., Wiley and Sons, 1995). For example, lambda phage cloning methodologies can be conveniently employed, using commercially available cloning systems (e.g., Lambda ZAP Express, Stratagene). Phage clones containing PSCA gene cDNAs can be identified by probing with a labeled PSCA cDNA or a fragment thereof. For example, in one embodiment, a PSCA cDNA (e.g., FIG. 2) or a portion thereof can be synthesized and used as a probe to retrieve overlapping and full-length cDNAs corresponding to a PSCA gene. A PSCA gene itself can be isolated by screening genomic DNA libraries, bacterial artificial chromosome libraries (BACs), yeast artificial chromosome libraries (YACs), and the like, with PSCA DNA probes or primers.

II.A.5.) Recombinant Nucleic Acid Molecules and Host-Vector Systems

The invention also provides recombinant DNA or RNA molecules containing a PSCA polynucleotide, a fragment, analog or homologue thereof, including but not limited to phages, plasmids, phagemids, cosmids, YACs, BACs, as well as various viral and non-viral vectors well known in the art, and cells transformed or transfected with such recombinant DNA or RNA molecules. Methods for generating such molecules are well known (see, for example, Sambrook et al., 1989, supra).

The invention further provides a host-vector system comprising a recombinant DNA molecule containing a PSCA polynucleotide, fragment, analog or homologue thereof within a suitable prokaryotic or eukaryotic host cell. Examples of suitable eukaryotic host cells include a yeast cell, a plant cell, or an animal cell, such as a mammalian cell or an insect cell (e.g., a baculovirus-infectible cell such as an Sf9 or HighFive cell). Examples of suitable mammalian cells include various prostate cancer cell lines such as DU145 and TsuPrl, other transfectable or transducible prostate cancer cell lines, primary cells (PrEC), as well as a number of mammalian cells routinely used for the expression of recombinant proteins (e.g., COS, CHO, 293, 293T cells). More particularly, a polynucleotide comprising the coding sequence of PSCA or a fragment, analog or homolog thereof can be used to generate PSCA proteins or fragments thereof using any number of host-vector systems routinely used and widely known in the art.

A wide range of host-vector systems suitable for the expression of PSCA proteins or fragments thereof are available, see for example, Sambrook et al., 1989, supra; Current Protocols in Molecular Biology, 1995, supra). Preferred vectors for mammalian expression include but are not limited to pcDNA 3.1 myc-His-tag (Invitrogen) and the retroviral vector pSRαtkneo (Muller et al., 1991, MCB 11:1785). Using these expression vectors, PSCA can be expressed in several prostate cancer and non-prostate cell lines, including for example 293, 293T, rat-1, NIH 3T3 and TsuPrl. The host-vector systems of the invention are useful for the production of a PSCA protein or fragment thereof. Such host-vector systems can be employed to study the functional properties of PSCA and PSCA mutations or analogs.

Recombinant human PSCA protein or an analog or homolog or fragment thereof can be produced by mammalian cells transfected with a construct encoding a PSCA-related nucleotide. For example, 293T cells can be transfected with an expression plasmid encoding PSCA or fragment, analog or homolog thereof, a PSCA-related protein is expressed in the 293T cells, and the recombinant PSCA protein is isolated using standard purification methods (e.g., affinity purification using anti-PSCA antibodies). In another embodiment, a PSCA coding sequence is subcloned into the retroviral vector pSRαMSVtkneo and used to infect various mammalian cell lines, such as NIH 3T3, TsuPrl, 293 and rat-1 in order to establish PSCA expressing cell lines. Various other expression systems well known in the art can also be employed. Expression constructs encoding a leader peptide joined in frame to a PSCA coding sequence can be used for the generation of a secreted form of recombinant PSCA protein.

As discussed herein, redundancy in the genetic code permits variation in PSCA gene sequences. In particular, it is known in the art that specific host species often have specific codon preferences, and thus one can adapt the disclosed sequence as preferred for a desired host. For example, preferred analog codon sequences typically have rare codons (i.e., codons having a usage frequency of less than about 20% in known sequences of the desired host) replaced with higher frequency codons. Codon preferences for a specific species are calculated, for example, by utilizing codon usage tables available on the INTERNET such as at URL dna.affrc.go.jp/~nakamura/codon.html.

Additional sequence modifications are known to enhance protein expression in a cellular host. These include elimination of sequences encoding spurious polyadenylation signals, exon/intron splice site signals, transposon-like repeats, and/or other such well-characterized sequences that are deleterious to gene expression. The GC content of the sequence is adjusted to levels average for a given cellular host, as calculated by reference to known genes expressed in the host cell. Where possible, the sequence is modified to avoid predicted hairpin secondary mRNA structures. Other useful modifications include the addition of a translational initiation consensus sequence at the start of the open reading frame, as described in Kozak, *Mol. Cell Biol.*, 9:5073-5080 (1989). Skilled artisans understand that the general rule that eukaryotic ribosomes initiate translation exclusively at the 5' proximal AUG codon is abrogated only under rare conditions (see, e.g., Kozak PNAS 92(7): 2662-2666, (1995) and Kozak NAR 15(20): 8125-8148 (1987)).

III.) PSCA-related Proteins

Another aspect of the present invention provides PSCA-related proteins. Specific embodiments of PSCA proteins comprise a polypeptide having all or part of the amino acid sequence of human PSCA as shown in FIG. 2 or FIG. 3. Alternatively, embodiments of PSCA proteins comprise variant, homolog or analog polypeptides that have alterations in the amino acid sequence of PSCA shown in FIG. 2 or FIG. 3.

Embodiments of a PSCA polypeptide include: a PSCA polypeptide having a sequence shown in FIG. 2, a peptide sequence of a PSCA as shown in FIG. 2 wherein T is U; at least 10 contiguous nucleotides of a polypeptide having the sequence as shown in FIG. 2; or, at least 10 contiguous peptides of a polypeptide having the sequence as shown in FIG. 2 where T is U. For example, embodiments of PSCA peptides comprise, without limitation:

(I) a protein comprising, consisting essentially of, or consisting of an amino acid sequence as shown in FIG. 2A-H or FIG. 3A-L;

(II) a PSCA-related protein that is at least 90, 91, 92, 93, 94, 95, 96, 97, 98, 99 or 100% homologous to an entire amino acid sequence shown in FIG. 2A-H or 3A-L;

(III) a PSCA-related protein that is at least 90, 91, 92, 93, 94, 95, 96, 97, 98, 99 or 100% identical to an entire amino acid sequence shown in FIG. 2A-H or 3A-L;

(IV) a protein that comprises at least one peptide set forth in Tables VIII to XLIX, optionally with a proviso that it is not an entire protein of FIG. 2;

(V) a protein that comprises at least one peptide set forth in Tables VIII-XXI, collectively, which peptide is also set forth in Tables XXII to XLIX, collectively, optionally with a proviso that it is not an entire protein of FIG. 2;

(VI) a protein that comprises at least two peptides selected from the peptides set forth in Tables VIII-XLIX, optionally with a proviso that it is not an entire protein of FIG. 2;

(VII) a protein that comprises at least two peptides selected from the peptides set forth in Tables VIII to XLIX collectively, with a proviso that the protein is not a contiguous sequence from an amino acid sequence of FIG. 2;

(VIII) a protein that comprises at least one peptide selected from the peptides set forth in Tables VIII-XXI; and at least one peptide selected from the peptides set forth in Tables XXII to XLIX, with a proviso that the protein is not a contiguous sequence from an amino acid sequence of FIG. 2;

(IX) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3A in any whole number increment up to 123 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(X) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3A, in any whole number increment up to 123 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XI) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3A, in any whole number increment up to 123 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3A, in any whole number increment up to 123 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XIII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, amino acids of a protein of FIG. 3A in any whole number increment up to 123 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XIV) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3B, in any whole number increment up to 94 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XV) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3B, in any whole number increment up to 94 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XVI) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3B, in any whole number increment up to 94 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XVII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3B, in any whole number increment up to 94 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XVIII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, amino acids of a protein of FIG. 3B in any whole number increment up to 94 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XIX) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3C, 3E-3L in any whole number increment up to 189 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XX) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3C, 3E-3L in any whole number increment up to 189 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XXI) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3C, 3E-3L in any whole number increment up to 189 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XXII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3C, 3E-3L in any whole number increment up to 189 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XXIII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, amino acids of a protein of FIG. 3C, 3E-3L in any whole number increment up to 189 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XXIV) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3D, in any whole number increment up to 114 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XXV) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3D, in any whole number increment up to 114 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XXVI) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3D, in any whole number increment up to 114 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XXVII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3D, in any whole number increment up to 114 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XXVIII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, amino acids of a protein of FIG. 3D in any whole number increment up to 114 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XXIX) a peptide that occurs at least twice in Tables VIII-XXI and XXII to XLIX, collectively;

(XXX) a peptide that occurs at least three times in Tables VIII-XXI and XXII to XLIX, collectively;

(XXXI) a peptide that occurs at least four times in Tables VIII-XXI and XXII to XLIX, collectively;

(XXXII) a peptide that occurs at least five times in Tables VIII-XXI and XXII to XLIX, collectively;

(XXXIII) a peptide that occurs at least once in Tables VIII-XXI, and at least once in tables XXII to XLIX;

(XXXIV) a peptide that occurs at least once in Tables VIII-XXI, and at least twice in tables XXII to XLIX;

(XXXV) a peptide that occurs at least twice in Tables VIII-XXI, and at least once in tables XXII to XLIX;

(XXXVI) a peptide that occurs at least twice in Tables VIII-XXI, and at least twice in tables XXII to XLIX;

(XXXVII) a peptide which comprises one two, three, four, or five of the following characteristics, or an oligonucleotide encoding such peptide:

i) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Hydrophilicity profile of FIG. 5;

ii) a region of at least 5 amino acids of a particular peptide of FIG. 3, in any whole number increment up to the full length of that protein in FIG. 3, that includes an amino acid position having a value equal to or less than 0.5, 0.4, 0.3, 0.2, 0.1, or having a value equal to 0.0, in the Hydropathicity profile of FIG. 6;

iii) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Percent Accessible Residues profile of FIG. 7;

iv) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Average Flexibility profile of FIG. 8; or, v) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Beta-turn profile of FIG. 9;

(XXXVIII) a composition comprising a peptide of (I)-(XXXVII) or an antibody or binding region thereof together with a pharmaceutical excipient and/or in a human unit dose form;

(XXXIX) a method of using a peptide of (I)-(XXXVII), or an antibody or binding region thereof or a composition of (XXXVIII) in a method to modulate a cell expressing PSCA;

(XL) a method of using a peptide of (I)-(XXXVII) or an antibody or binding region thereof or a composition of (XXXVIII) in a method to diagnose, prophylax, prognose, or treat an individual who bears a cell expressing PSCA;

(XLI) a method of using a peptide of (I)-(XXXVII) or an antibody or binding region thereof or a composition of (XXXVIII) in a method to diagnose, prophylax, prognose, or treat an individual who bears a cell expressing PSCA, said cell from a cancer of a tissue listed in Table I;

(XLII) a method of using a peptide of (I)-(XXXVII) or an antibody or binding region thereof or a composition of (XXXVIII) in a method to diagnose, prophylax, prognose, or treat a a cancer;

(XLIII) a method of using a peptide of (I)-(XXXVII) or an antibody or binding region thereof or a composition of (XXXVIII) in a method to diagnose, prophylax, prognose, or treat a a cancer of a tissue listed in Table I; and;

(XLIV) a method of using a a peptide of (I)-(XXXVII) or an antibody or binding region thereof or a composition (XXXVIII) in a method to identify or characterize a modulator of a cell expressing PSCA.

As used herein, a range is understood to specifically disclose all whole unit positions thereof.

Typical embodiments of the invention disclosed herein include PSCA polynucleotides that encode specific portions of PSCA mRNA sequences (and those which are complementary to such sequences) such as those that encode the proteins and/or fragments thereof, for example:

(a) 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, and 123 or more contiguous amino acids of PSCA variant 1; the maximal lengths relevant for other variants are: variant 3, 94 amino acids; variant 4, 189 amino acids, variant 6, 114 amino acids, variant 19, 189 amino acids, variant 20, 189 amino acids, variant 21, 189 amino acids, variant 22, 189 amino acids, variant 24, 189 amino acids, variant 25, 189 amino acids, variant 26, 189 amino acids, and variant 27, 189 amino acids.

In general, naturally occurring allelic variants of human PSCA share a high degree of structural identity and homology (e.g., 90% or more homology). Typically, allelic variants of a PSCA protein contain conservative amino acid substitutions within the PSCA sequences described herein or contain a substitution of an amino acid from a corresponding position in a homologue of PSCA. One class of PSCA allelic variants are proteins that share a high degree of homology with at least a small region of a particular PSCA amino acid sequence, but further contain a radical departure from the sequence, such as a non-conservative substitution, truncation, insertion or frame shift. In comparisons of protein sequences, the terms, similarity, identity, and homology each have a distinct meaning as appreciated in the field of genetics. Moreover, orthology and paralogy can be important concepts describing the relationship of members of a given protein family in one organism to the members of the same family in other organisms.

Amino acid abbreviations are provided in Table II. Conservative amino acid substitutions can frequently be made in a protein without altering either the conformation or the function of the protein. Proteins of the invention can comprise 1, 2, 3, 4, 5, 6, 7, 8, 9, 10, 11, 12, 13, 14, 15 conservative substitutions. Such changes include substituting any of isoleucine (I), valine (V), and leucine (L) for any other of these hydrophobic amino acids; aspartic acid (D) for glutamic acid (E) and vice versa; glutamine (Q) for asparagine (N) and vice versa; and serine (S) for threonine (T) and vice versa. Other substitutions can also be considered conservative, depending on the environment of the particular amino acid and its role in the three-dimensional structure of the protein. For example, glycine (G) and alanine (A) can frequently be interchangeable, as can alanine (A) and valine (V). Methionine (M), which is relatively hydrophobic, can frequently be interchanged with leucine and isoleucine, and sometimes with valine. Lysine (K) and arginine (R) are frequently interchangeable in locations in which the significant feature of the amino acid residue is its charge and the differing pK's of these two amino acid residues are not significant. Still other changes can be considered "conservative" in particular environments (see, e.g. Table III herein; pages 13-15 "Biochemistry" $2_{nd}$ nd ED. Lubert Stryer ed (Stanford University); Henikoff et al., PNAS 1992 Vol 89 10915-10919; Lei et al., J Biol Chem 1995 May 19; 270(20):11882-6).

Embodiments of the invention disclosed herein include a wide variety of art-accepted variants or analogs of PSCA proteins such as polypeptides having amino acid insertions, deletions and substitutions. PSCA variants can be made using methods known in the art such as site-directed mutagenesis, alanine scanning, and PCR mutagenesis. Site-directed mutagenesis (Carter et al., *Nucl. Acids Res.*, 13:4331 (1986); Zoller et al., *Nucl. Acids Res.*, 10:6487 (1987)), cassette mutagenesis (Wells et al., Gene, 34:315 (1985)), restriction selection mutagenesis (Wells et al., *Philos. Trans. R. Soc. London SerA,* 317:415 (1986)) or other known techniques can be performed on the cloned DNA to produce the PSCA variant DNA.

Scanning amino acid analysis can also be employed to identify one or more amino acids along a contiguous sequence that is involved in a specific biological activity such as a protein-protein interaction. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant. Alanine is also typically preferred because it is the most common amino acid. Further, it is frequently found in both buried and exposed positions (Creighton, *The Proteins*, (W. H. Freeman & Co., N.Y.); Chothia, J. Mol. Biol., 150:1 (1976)). If alanine substitution does not yield adequate amounts of variant, an isosteric amino acid can be used.

As defined herein, PSCA variants, analogs or homologs, have the distinguishing attribute of having at least one epitope that is "cross reactive" with a PSCA protein having an amino acid sequence of FIG. 3. As used in this sentence, "cross reactive" means that an antibody or T cell that specifically binds to a PSCA variant also specifically binds to a PSCA protein having an amino acid sequence set forth in FIG. 3. A polypeptide ceases to be a variant of a protein shown in FIG. 3, when it no longer contains any epitope capable of being recognized by an antibody or T cell that specifically binds to the starting PSCA protein. Those skilled in the art understand that antibodies that recognize proteins bind to epitopes of varying size, and a grouping of the order of about four or five amino acids, contiguous or not, is regarded as a typical number of amino acids in a minimal epitope. See, e.g., Nair et al., J. Immunol 2000 165(12): 6949-6955; Hebbes et al., Mol Immunol (1989) 26(9):865-73; Schwartz et al., J Immunol (1985) 135(4):2598-608.

Other classes of PSCA-related protein variants share 70%, 75%, 80%, 85% or 90% or more similarity with an amino acid sequence of FIG. 3, or a fragment thereof. Another specific class of PSCA protein variants or analogs comprises one or more of the PSCA biological motifs described herein or presently known in the art. Thus, encompassed by the present invention are analogs of PSCA fragments (nucleic or amino acid) that have altered functional (e.g. immunogenic) properties relative to the starting fragment. It is to be appreciated that motifs now or which become part of the art are to be applied to the nucleic or amino acid sequences of FIG. 2 or FIG. 3.

As discussed herein, embodiments of the claimed invention include polypeptides containing less than the full amino acid sequence of a PSCA protein shown in FIG. 2 or FIG. 3. For example, representative embodiments of the invention comprise peptides/proteins having any 4, 5, 6, 7, 8, 9, 10, 11, 12, 13, 14, 15 or more contiguous amino acids of a PSCA protein shown in FIG. 2 or FIG. 3.

Moreover, representative embodiments of the invention disclosed herein include polypeptides consisting of about amino acid 1 to about amino acid 10 of a PSCA protein shown in FIG. 2 or FIG. 3, polypeptides consisting of about amino acid 10 to about amino acid 20 of a PSCA protein shown in FIG. 2 or FIG. 3, polypeptides consisting of about amino acid 20 to about amino acid 30 of a PSCA protein shown in FIG. 2 or FIG. 3, polypeptides consisting of about amino acid 30 to about amino acid 40 of a PSCA protein shown in FIG. 2 or FIG. 3, polypeptides consisting of about amino acid 40 to about amino acid 50 of a PSCA protein shown in FIG. 2 or FIG. 3, polypeptides consisting of about amino acid 50 to about amino acid 60 of a PSCA protein shown in FIG. 2 or FIG. 3, polypeptides consisting of about amino acid 60 to about amino acid 70 of a PSCA protein shown in FIG. 2 or FIG. 3, polypeptides consisting of about amino acid 70 to about amino acid 80 of a PSCA protein shown in FIG. 2 or FIG. 3, polypeptides consisting of about amino acid 80 to about amino acid 90 of a PSCA protein shown in FIG. 2 or FIG. 3, polypeptides consisting of about amino acid 90 to about amino acid 100 of a PSCA protein shown in FIG. 2 or FIG. 3, etc. throughout the entirety of a PSCA amino acid sequence. Moreover, polypeptides consisting of about amino acid 1 (or 20 or 30 or 40 etc.) to about amino acid 20, (or 130, or 140 or 150 etc.) of a PSCA protein shown in FIG. 2 or FIG. 3 are embodiments of the invention. It is to be appreciated that the starting and stopping positions in this paragraph refer to the specified position as well as that position plus or minus 5 residues.

PSCA-related proteins are generated using standard peptide synthesis technology or using chemical cleavage methods well known in the art. Alternatively, recombinant methods can be used to generate nucleic acid molecules that encode a PSCA-related protein. In one embodiment, nucleic acid molecules provide a means to generate defined fragments of a PSCA protein (or variants, homologs or analogs thereof).

III.A.) Motif-bearing Protein Embodiments

Additional illustrative embodiments of the invention disclosed herein include PSCA polypeptides comprising the amino acid residues of one or more of the biological motifs contained within a PSCA polypeptide sequence set forth in FIG. 2 or FIG. 3. Various motifs are known in the art, and a protein can be evaluated for the presence of such motifs by a number of publicly available Internet sites (see, e.g., URL addresses: pfam.wustl.edu/; searchlauncher.bcm.tmc.edu/seq-search/struc-predict.html; psort.ims.u-tokyo.ac.jp/; cbs-.dtu.dk/; ebi.ac.uk/interpro/scan.html; expasy.ch/tools/scnpsit1.html; Epimatrix™ and Epimer™, Brown University, brown.edu/Research/TB-HIV_Lab/epimatrix/epimatrix.html; and BIMAS, bimas.dcrt.nih.gov/.).

Motif bearing subsequences of all PSCA variant proteins are set forth and identified in Tables VIII-XXI and XXII-XLIX.

Table V sets forth several frequently occurring motifs based on pfam searches (see URL address pfam.wustl.edu/). The columns of Table V list (1) motif name abbreviation, (2) percent identity found amongst the different member of the motif family, (3) motif name or description and (4) most common function; location information is included if the motif is relevant for location.

Polypeptides comprising one or more of the PSCA motifs discussed above are useful in elucidating the specific characteristics of a malignant phenotype in view of the observation that the PSCA motifs discussed above are associated with growth dysregulation and because PSCA is overexpressed in certain cancers (See, e.g., Table I). Casein kinase II, cAMP and camp-dependent protein kinase, and Protein Kinase C, for example, are enzymes known to be associated with the development of the malignant phenotype (see e.g. Chen et al., Lab Invest., 78(2): 165-174 (1998); Gaiddon et al., Endocrinology 136(10): 4331-4338 (1995); Hall et al., Nucleic Acids Research 24(6): 1119-1126 (1996); Peterziel et al., Oncogene 18(46): 6322-6329 (1999) and O'Brian, Oncol. Rep. 5(2): 305-309 (1998)). Moreover, both glycosylation and myristoylation are protein modifications also associated with cancer and cancer progression (see e.g. Dennis et al., Biochem. Biophys. Acta 1473(1):21-34 (1999); Raju et al., Exp. Cell Res. 235(1): 145-154 (1997)). Amidation is another protein modification also associated with cancer and cancer progression (see e.g. Treston et al., J. Natl. Cancer Inst. Monogr. (13): 169-175 (1992)).

In another embodiment, proteins of the invention comprise one or more of the immunoreactive epitopes identified in accordance with art-accepted methods, such as the peptides set forth in Tables VIII-XXI and XXII-XLIX. CTL epitopes can be determined using specific algorithms to identify peptides within a PSCA protein that are capable of optimally binding to specified HLA alleles (e.g., Table IV; Epimatrix™ and Epimer™, Brown University, URL brown.edu/Research/TB-HIV_Lab/epimatrix/epimatrix.html; and BIMAS, URL bimas.dcrt.nih.gov/.) Moreover, processes for identifying peptides that have sufficient binding affinity for HLA molecules and which are correlated with being immunogenic epitopes, are well known in the art, and are carried out without undue experimentation. In addition, processes for identifying peptides that are immunogenic epitopes, are well known in the art, and are carried out without undue experimentation either in vitro or in vivo.

Also known in the art are principles for creating analogs of such epitopes in order to modulate immunogenicity. For example, one begins with an epitope that bears a CTL or HTL motif (see, e.g., the HLA Class I and HLA Class II motifs/supermotifs of Table IV). The epitope is analoged by substituting out an amino acid at one of the specified positions, and replacing it with another amino acid specified for that position. For example, on the basis of residues defined in Table IV, one can substitute out a deleterious residue in favor of any other residue, such as a preferred residue; substitute a less-preferred residue with a preferred residue; or substitute an originally-occurring preferred residue with another preferred residue. Substitutions can occur at primary anchor positions or at other positions in a peptide; see, e.g., Table IV.

A variety of references reflect the art regarding the identification and generation of epitopes in a protein of interest as well as analogs thereof. See, for example, WO 97/33602 to Chesnut et al.; Sette, Immunogenetics 1999 50(3-4): 201-212; Sette et al., J. Immunol. 2001 166(2): 1389-1397; Sidney et al., Hum. Immunol. 1997 58(1): 12-20; Kondo et al., Immunogenetics 1997 45(4): 249-258; Sidney et al., J. Immunol. 1996 157(8): 3480-90; and Falk et al., Nature 351: 290-6 (1991); Hunt et al., Science 255:1261-3 (1992); Parker et al., J. Immunol. 149:3580-7 (1992); Parker et al., J. Immunol. 152:163-75 (1994)); Kast et al., 1994 152(8): 3904-12; Borras-Cuesta et al., Hum. Immunol. 2000 61(3): 266-278; Alexander et al., J. Immunol. 2000 164(3); 164(3): 1625-1633; Alexander et al., PMID: 7895164, UI: 95202582; O'Sullivan et al., J. Immunol. 1991 147(8): 2663-2669; Alexander et al., Immunity 1994 1(9): 751-761 and Alexander et al., Immunol. Res. 1998 18(2): 79-92.

Related embodiments of the invention include polypeptides comprising combinations of the different motifs set forth in Table VI, and/or, one or more of the predicted CTL epitopes of Tables VIII-XXI and XXII-XLIX, and/or, one or more of the predicted HTL epitopes of Tables XLVI-XLIX, and/or, one or more of the T cell binding motifs known in the art. Preferred embodiments contain no insertions, deletions or substitutions either within the motifs or within the intervening sequences of the polypeptides. In addition, embodiments which include a number of either N-terminal and/or C-terminal amino acid residues on either side of these motifs may be desirable (to, for example, include a greater portion of the polypeptide architecture in which the motif is located). Typically, the number of N-terminal and/or C-terminal amino acid residues on either side of a motif is between about 1 to about 100 amino acid residues, preferably 5 to about 50 amino acid residues.

PSCA-related proteins are embodied in many forms, preferably in isolated form. A purified PSCA protein molecule will be substantially free of other proteins or molecules that impair the binding of PSCA to antibody, T cell or other ligand. The nature and degree of isolation and purification will depend on the intended use. Embodiments of a PSCA-related proteins include purified PSCA-related proteins and functional, soluble PSCA-related proteins. In one embodiment, a functional, soluble PSCA protein or fragment thereof retains the ability to be bound by antibody, T cell or other ligand.

The invention also provides PSCA proteins comprising biologically active fragments of a PSCA amino acid sequence shown in FIG. 2 or FIG. 3. Such proteins exhibit properties of the starting PSCA protein, such as the ability to elicit the generation of antibodies that specifically bind an epitope associated with the starting PSCA protein; to be bound by such antibodies; to elicit the activation of HTL or CTL; and/or, to be recognized by HTL or CTL that also specifically bind to the starting protein.

PSCA-related polypeptides that contain particularly interesting structures can be predicted and/or identified using various analytical techniques well known in the art, including, for example, the methods of Chou-Fasman, Garnier-Robson, Kyte-Doolittle, Eisenberg, Karplus-Schultz or Jameson-Wolf analysis, or based on immunogenicity. Fragments that contain such structures are particularly useful in generating subunit-specific anti-PSCA antibodies or T cells or in identifying cellular factors that bind to PSCA. For example, hydrophilicity profiles can be generated, and immunogenic peptide fragments identified, using the method of Hopp, T. P. and Woods, K. R., 1981, Proc. Natl. Acad. Sci. U.S.A. 78:3824-3828. Hydropathicity profiles can be generated, and immunogenic peptide fragments identified, using the method of Kyte, J. and Doolittle, R. F., 1982, J. Mol. Biol. 157:105-132. Percent (%) Accessible Residues profiles can be generated, and immunogenic peptide fragments identified, using the method of Janin J., 1979, Nature 277:491-492. Average Flexibility profiles can be generated, and immunogenic peptide fragments identified, using the method of Bhaskaran R., Ponnuswamy P. K., 1988, Int. J. Pept. Protein Res. 32:242-255. Beta-turn profiles can be generated, and immunogenic peptide fragments identified, using the method of Deleage, G., Roux B., 1987, Protein Engineering 1:289-294.

CTL epitopes can be determined using specific algorithms to identify peptides within a PSCA protein that are capable of optimally binding to specified HLA alleles (e.g., by using the SYFPEITHI site at World Wide Web URL syfpeithi.bmi-heidelberg.com/; the listings in Table IV(A)-(E); Epimatrix™ and Epimer™, Brown University, URL (brown.edu/Research/TB-HIV_Lab/epimatrix/epimatrix.html); and BIMAS, URL bimas.dcrt.nih.gov/). Illustrating this, peptide epitopes from PSCA that are presented in the context of human MHC Class I molecules, e.g., HLA-A1, A2, A3, A11, A24, B7 and B35 were predicted (see, e.g., Tables VIII-XXI, XXII-XLIX). Specifically, the complete amino acid sequence of the PSCA protein and relevant portions of other variants, i.e., for HLA Class I predictions 9 flanking residues on either side of a point mutation or exon juction, and for HLA Class II predictions 14 flanking residues on either side of a point mutation or exon junction corresponding to that variant, were entered into the HLA Peptide Motif Search algorithm found in the Bioinformatics and Molecular Analysis Section (BIMAS) web site listed above; in addition to the site SYFPEITHI, at URL syfpeithi.bmi-heidelberg.com/.

The HLA peptide motif search algorithm was developed by Dr. Ken Parker based on binding of specific peptide sequences in the groove of HLA Class I molecules, in particular HLA-A2 (see, e.g., Falk et al., Nature 351: 290-6 (1991); Hunt et al., Science 255:1261-3 (1992); Parker et al., J. Immunol. 149:3580-7 (1992); Parker et al., J. Immunol. 152:163-75 (1994)). This algorithm allows location and ranking of 8-mer, 9-mer, and 10-mer peptides from a complete protein sequence for predicted binding to HLA-A2 as well as numerous other HLA Class I molecules. Many HLA class I binding peptides are 8-, 9-, 10 or 11-mers. For example, for Class I HLA-A2, the epitopes preferably contain a leucine (L) or methionine (M) at position 2 and a valine (V) or leucine (L) at the C-terminus (see, e.g., Parker et al., J. Immunol. 149: 3580-7 (1992)). Selected results of PSCA predicted binding peptides are shown in Tables VIII-XXI and XXII-XLIX herein. In Tables VIII-XXI and XXII-XLVII, selected candidates, 9-mers and 10-mers, for each family member are shown along with their location, the amino acid sequence of each specific peptide, and an estimated binding score. In Tables XLVI-XLIX, selected candidates, 15-mers, for each family member are shown along with their location, the amino acid sequence of each specific peptide, and an estimated binding score. The binding score corresponds to the estimated half time of dissociation of complexes containing the peptide at 37° C. at pH 6.5. Peptides with the highest binding score are predicted to be the most tightly bound to HLA Class I on the cell surface for the greatest period of time and thus represent the best immunogenic targets for T-cell recognition.

Actual binding of peptides to an HLA allele can be evaluated by stabilization of HLA expression on the antigen-processing defective cell line T2 (see, e.g., Xue et al., Prostate 30:73-8 (1997) and Peshwa et al., Prostate 36:129-38 (1998)). Immunogenicity of specific peptides can be evaluated in vitro by stimulation of CD8+ cytotoxic T lymphocytes (CTL) in the presence of antigen presenting cells such as dendritic cells.

It is to be appreciated that every epitope predicted by the BIMAS site, Epimer™ and Epimatrix™ sites, or specified by the HLA class I or class II motifs available in the art or which become part of the art such as set forth in Table IV (or determined using World Wide Web site URL syfpeithi.bmi-heidelberg.com/, or BIMAS, bimas.dcrt.nih.gov/) are to be "applied" to a PSCA protein in accordance with the invention. As used in this context "applied" means that a PSCA protein is evaluated, e.g., visually or by computer-based patterns finding methods, as appreciated by those of skill in the relevant art. Every subsequence of a PSCA protein of 8, 9, 10, or 11 amino acid residues that bears an HLA Class I motif, or a subsequence of 9 or more amino acid residues that bear an HLA Class II motif are within the scope of the invention.

III.B.) Expression of PSCA-related Proteins

In an embodiment described in the examples that follow, PSCA can be conveniently expressed in cells (such as 293T cells) transfected with a commercially available expression vector such as a CMV-driven expression vector encoding PSCA with a C-terminal 6XHis and MYC tag (pcDNA3.1/mycHIS, Invitrogen or Tag5, GenHunter Corporation, Nashville Tenn.). The Tag5 vector provides an IgGK secretion signal that can be used to facilitate the production of a secreted PSCA protein in transfected cells. The secreted HIS-tagged PSCA in the culture media can be purified, e.g., using a nickel column using standard techniques.

III.C.) Modifications of PSCA-related Proteins

Modifications of PSCA-related proteins such as covalent modifications are included within the scope of this invention. One type of covalent modification includes reacting targeted amino acid residues of a PSCA polypeptide with an organic derivatizing agent that is capable of reacting with selected side chains or the N- or C-terminal residues of a PSCA protein. Another type of covalent modification of a PSCA polypeptide included within the scope of this invention comprises altering the native glycosylation pattern of a protein of the invention. Another type of covalent modification of PSCA comprises linking a PSCA polypeptide to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or 4,179,337.

The PSCA-related proteins of the present invention can also be modified to form a chimeric molecule comprising PSCA fused to another, heterologous polypeptide or amino acid sequence. Such a chimeric molecule can be synthesized chemically or recombinantly. A chimeric molecule can have a protein of the invention fused to another tumor-associated antigen or fragment thereof. Alternatively, a protein in accordance with the invention can comprise a fusion of fragments of a PSCA sequence (amino or nucleic acid) such that a molecule is created that is not, through its length, directly homologous to the amino or nucleic acid sequences shown in FIG. 2 or FIG. 3. Such a chimeric molecule can comprise multiples of the same subsequence of PSCA. A chimeric molecule can comprise a fusion of a PSCA-related protein with a polyhistidine epitope tag, which provides an epitope to which immobilized nickel can selectively bind, with cytokines or with growth factors. The epitope tag is generally placed at the amino- or carboxyl-terminus of a PSCA protein. In an alternative embodiment, the chimeric molecule can comprise a fusion of a PSCA-related protein with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a PSCA polypeptide in place of at least one variable region within an Ig molecule. In a preferred embodiment, the immunoglobulin fusion includes the hinge, CH2 and CH3, or the hinge, CHI, CH2 and CH3 regions of an IgGI molecule. For the production of immunoglobulin fusions see, e.g., U.S. Pat. No. 5,428,130 issued Jun. 27, 1995.

III.D.) Uses of PSCA-related Proteins

The proteins of the invention have a number of different specific uses. As PSCA is highly expressed in prostate and other cancers, PSCA-related proteins are used in methods that assess the status of PSCA gene products in normal versus cancerous tissues, thereby elucidating the malignant phenotype. Typically, polypeptides from specific regions of a PSCA protein are used to assess the presence of perturbations (such as deletions, insertions, point mutations etc.) in those regions (such as regions containing one or more motifs). Exemplary assays utilize antibodies or T cells targeting PSCA-related proteins comprising the amino acid residues of one or more of the biological motifs contained within a PSCA polypeptide sequence in order to evaluate the characteristics of this region in normal versus cancerous tissues or to elicit an immune response to the epitope. Alternatively, PSCA-related proteins that contain the amino acid residues of one or more of the biological motifs in a PSCA protein are used to screen for factors that interact with that region of PSCA.

PSCA protein fragments/subsequences are particularly useful in generating and characterizing domain-specific antibodies (e.g., antibodies recognizing an extracellular or intracellular epitope of a PSCA protein), for identifying agents or cellular factors that bind to PSCA or a particular structural domain thereof, and in various therapeutic and diagnostic contexts, including but not limited to diagnostic assays, cancer vaccines and methods of preparing such vaccines.

Proteins encoded by the PSCA genes, or by analogs, homologs or fragments thereof, have a variety of uses, including but not limited to generating antibodies and in methods for identifying ligands and other agents and cellular constituents that bind to a PSCA gene product. Antibodies raised against a PSCA protein or fragment thereof are useful in diagnostic and prognostic assays, and imaging methodologies in the management of human cancers characterized by expression of PSCA protein, such as those listed in Table I. Such antibodies can be expressed intracellularly and used in methods of treating patients with such cancers. PSCA-related nucleic acids or proteins are also used in generating HTL or CTL responses.

Various immunological assays useful for the detection of PSCA proteins are used, including but not limited to various types of radioimmunoassays, enzyme-linked immunosorbent assays (ELISA), enzyme-linked immunofluorescent assays (ELIFA), immunocytochemical methods, and the like. Antibodies can be labeled and used as immunological imaging reagents capable of detecting PSCA-expressing cells (e.g., in radioscintigraphic imaging methods). PSCA proteins are also particularly useful in generating cancer vaccines, as further described herein.

IV.) PSCA Antibodies

Another aspect of the invention provides antibodies that bind to PSCA-related proteins. Preferred antibodies specifically bind to a PSCA-related protein and do not bind (or bind weakly) to peptides or proteins that are not PSCA-related proteins under physiological conditions. In this context, examples of physiological conditions include: 1) phosphate buffered saline; 2) Tris-buffered saline containing 25 mM Tris and 150 mM NaCl; or normal saline (0.9% NaCl); 4) animal serum such as human serum; or, 5) a combination of any of 1) through 4); these reactions preferably taking place at pH 7.5, alternatively in a range of pH 7.0 to 8.0, or alternatively in a range of pH 6.5 to 8.5; also, these reactions taking place at a temperature between 4° C. to 37° C. For example, antibodies that bind PSCA can bind PSCA-related proteins such as the homologs or analogs thereof.

PSCA antibodies of the invention are particularly useful in cancer (see, e.g., Table I) diagnostic and prognostic assays, and imaging methodologies. Similarly, such antibodies are useful in the treatment, diagnosis, and/or prognosis of other cancers, to the extent PSCA is also expressed or overexpressed in these other cancers. Moreover, intracellularly expressed antibodies (e.g., single chain antibodies) are therapeutically useful in treating cancers in which the expression of PSCA is involved, such as advanced or metastatic prostate cancers.

The invention also provides various immunological assays useful for the detection and quantification of PSCA and mutant PSCA-related proteins. Such assays can comprise one or more PSCA antibodies capable of recognizing and binding a PSCA-related protein, as appropriate. These assays are performed within various immunological assay formats well known in the art, including but not limited to various types of radioimmunoassays, enzyme-linked immunosorbent assays (ELISA), enzyme-linked immunofluorescent assays (ELIFA), and the like.

Immunological non-antibody assays of the invention also comprise T cell immunogenicity assays (inhibitory or stimulatory) as well as major histocompatibility complex (MHC) binding assays.

In addition, immunological imaging methods capable of detecting prostate cancer and other cancers expressing PSCA are also provided by the invention, including but not limited to radioscintigraphic imaging methods using labeled PSCA antibodies. Such assays are clinically useful in the detection, monitoring, and prognosis of PSCA expressing cancers such as prostate cancer.

PSCA antibodies are also used in methods for purifying a PSCA-related protein and for isolating PSCA homologues and related molecules. For example, a method of purifying a PSCA-related protein comprises incubating a PSCA antibody, which has been coupled to a solid matrix, with a lysate or other solution containing a PSCA-related protein under conditions that permit the PSCA antibody to bind to the PSCA-related protein; washing the solid matrix to eliminate impurities; and eluting the PSCA-related protein from the coupled antibody. Other uses of PSCA antibodies in accordance with the invention include generating anti-idiotypic antibodies that mimic a PSCA protein.

Various methods for the preparation of antibodies are well known in the art. For example, antibodies can be prepared by immunizing a suitable mammalian host using a PSCA-related protein, peptide, or fragment, in isolated or immunoconjugated form (Antibodies: A Laboratory Manual, CSH Press, Eds., Harlow, and Lane (1988); Harlow, Antibodies, Cold Spring Harbor Press, NY (1989)). In addition, fusion proteins of PSCA can also be used, such as a PSCA GST-fusion protein. In a particular embodiment, a GST fusion protein comprising all or most of the amino acid sequence of FIG. 2 or FIG. 3 is produced, then used as an immunogen to generate appropriate antibodies. In another embodiment, a PSCA-related protein is synthesized and used as an immunogen.

In addition, naked DNA immunization techniques known in the art are used (with or without purified PSCA-related protein or PSCA expressing cells) to generate an immune response to the encoded immunogen (for review, see Donnelly et al., 1997, Ann. Rev. Immunol. 15: 617-648).

The amino acid sequence of a PSCA protein as shown in FIG. 2 or FIG. 3 can be analyzed to select specific regions of the PSCA protein for generating antibodies. For example, hydrophobicity and hydrophilicity analyses of a PSCA amino acid sequence are used to identify hydrophilic regions in the PSCA structure. Regions of a PSCA protein that show immunogenic structure, as well as other regions and domains, can readily be identified using various other methods known in the art, such as Chou-Fasman, Garnier-Robson, Kyte-Doolittle, Eisenberg, Karplus-Schultz or Jameson-Wolf analysis. Hydrophilicity profiles can be generated using the method of Hopp, T. P. and Woods, K. R., 1981, Proc. Natl. Acad. Sci. U.S.A. 78:3824-3828. Hydropathicity profiles can be generated using the method of Kyte, J. and Doolittle, R. F., 1982, J. Mol. Biol. 157:105-132. Percent (%) Accessible Residues profiles can be generated using the method of Janin J., 1979, Nature 277:491-492. Average Flexibility profiles can be generated using the method of Bhaskaran R., Ponnuswamy P. K., 1988, Int. J. Pept. Protein Res. 32:242-255. Beta-turn profiles can be generated using the method of Deleage, G., Roux B., 1987, Protein Engineering 1:289-294. Thus, each region identified by any of these programs or methods is within the scope of the present invention. Methods for the generation of PSCA antibodies are further illustrated by way of the examples provided herein. Methods for preparing a protein or polypeptide for use as an immunogen are well known in the art. Also well known in the art are methods for preparing immunogenic conjugates of a protein with a carrier, such as BSA, KLH or other carrier protein. In some circumstances, direct conjugation using, for example, carbodiimide reagents are used; in other instances linking reagents such as those supplied by Pierce Chemical Co., Rockford, Ill., are effective. Administration of a PSCA immunogen is often conducted by injection over a suitable time period and with use of a suitable adjuvant, as is understood in the art. During the immunization schedule, titers of antibodies can be taken to determine adequacy of antibody formation.

PSCA monoclonal antibodies can be produced by various means well known in the art. For example, immortalized cell lines that secrete a desired monoclonal antibody are prepared using the standard hybridoma technology of Kohler and Milstein or modifications that immortalize antibody-producing B cells, as is generally known. Immortalized cell lines that secrete the desired antibodies are screened by immunoassay in which the antigen is a PSCA-related protein. When the appropriate immortalized cell culture is identified, the cells can be expanded and antibodies produced either from in vitro cultures or from ascites fluid.

The antibodies or fragments of the invention can also be produced, by recombinant means. Regions that bind specifically to the desired regions of a PSCA protein can also be produced in the context of chimeric or complementarity-determining region (CDR) grafted antibodies of multiple species origin. Humanized or human PSCA antibodies can also be produced, and are preferred for use in therapeutic contexts. Methods for humanizing murine and other non-human antibodies, by substituting one or more of the non-human antibody CDRs for corresponding human antibody sequences, are well known (see for example, Jones et al., 1986, Nature 321: 522-525; Riechmann et al., 1988, Nature 332: 323-327; Verhoeyen et al., 1988, Science 239: 1534-1536). See also, Carter et al., 1993, Proc. Natl. Acad. Sci. USA 89: 4285 and Sims et al., 1993, J. Immunol. 151: 2296.

Methods for producing fully human monoclonal antibodies include phage display and transgenic methods (for review, see Vaughan et al., 1998, Nature Biotechnology 16: 535-539). Fully human PSCA monoclonal antibodies can be generated using cloning technologies employing large human Ig gene combinatorial libraries (i.e., phage display) (Griffiths and Hoogenboom, Building an in vitro immune system: human antibodies from phage display libraries. In: Protein Engineering of Antibody Molecules for Prophylactic and Therapeutic Applications in Man, Clark, M. (Ed.), Nottingham Academic, pp 45-64 (1993); Burton and Barbas, Human Antibodies from combinatorial libraries. Id., pp 65-82). Fully human PSCA monoclonal antibodies can also be produced using transgenic mice engineered to contain human immunoglobulin gene loci as described in PCT Patent Application WO98/24893, Kucherlapati and Jakobovits et al., published Dec. 3, 1997 (see also, Jakobovits, 1998, Exp. Opin. Invest. Drugs 7(4): 607-614; U.S. Pat. No. 6,162,963 issued 19 Dec. 2000; U.S. Pat. No. 6,150,584 issued 12 Nov. 2000; and, U.S. Pat. No. 6,114,598 issued 5 Sep. 2000). This method avoids the in vitro manipulation required with phage display technology and efficiently produces high affinity authentic human antibodies.

Reactivity of PSCA antibodies with a PSCA-related protein can be established by a number of well known means, including Western blot, immunoprecipitation, ELISA, and FACS analyses using, as appropriate, PSCA-related proteins, PSCA-expressing cells or extracts thereof. A PSCA antibody or fragment thereof can be labeled with a detectable marker or conjugated to a second molecule. Suitable detectable markers include, but are not limited to, a radioisotope, a fluorescent compound, a bioluminescent compound, chemiluminescent compound, a metal chelator or an enzyme. Further, bi-specific antibodies specific for two or more PSCA epitopes are generated using methods generally known in the art. Homodimeric antibodies can also be generated by cross-linking techniques known in the art (e.g., Wolff et al., Cancer Res. 53: 2560-2565).

V.) PSCA Cellular Immune Responses

The mechanism by which T cells recognize antigens has been delineated. Efficacious peptide epitope vaccine compositions of the invention induce a therapeutic or prophylactic immune responses in very broad segments of the world-wide population. For an understanding of the value and efficacy of compositions of the invention that induce cellular immune responses, a brief review of immunology-related technology is provided.

A complex of an HLA molecule and a peptidic antigen acts as the ligand recognized by HLA-restricted T cells (Buus, S. et al., *Cell* 47:1071, 1986; Babbitt, B. P. et al., *Nature* 317: 359, 1985; Townsend, A. and Bodmer, H., *Annu. Rev. Immunol.* 7:601, 1989; Germain, R. N., *Annu. Rev. Immunol.* 11:403, 1993). Through the study of single amino acid substituted antigen analogs and the sequencing of endogenously bound, naturally processed peptides, critical residues that correspond to motifs required for specific binding to HLA antigen molecules have been identified and are set forth in Table IV (see also, e.g., Southwood, et al., *J. Immunol.* 160: 3363, 1998; Rammensee, et al., *Immunogenetics* 41:178, 1995; Rammensee et al., SYFPEITHI, access via World Wide Web at URL (134.2.96.221/scripts.hlaserver.dll/home.htm); Sette, A. and Sidney, J. *Curr. Opin. Immunol.* 10:478, 1998; Engelhard, V. H., *Curr. Opin. Immunol.* 6:13, 1994; Sette, A. and Grey, H. M., *Curr. Opin. Immunol.* 4:79, 1992; Sinigaglia, F. and Hammer, J. *Curr. Biol.* 6:52, 1994; Ruppert et al., *Cell* 74:929-937, 1993; Kondo et al., *J. Immunol.* 155: 4307-4312, 1995; Sidney et al., *J. Immunol.* 157:3480-3490, 1996; Sidney et al., *Human Immunol.* 45:79-93, 1996; Sette, A. and Sidney, J. *Immunogenetics* 1999 November; 50(3-4): 201-12, Review).

Furthermore, x-ray crystallographic analyses of HLA-peptide complexes have revealed pockets within the peptide binding cleft/groove of HLA molecules which accommodate, in an allele-specific mode, residues borne by peptide ligands; these residues in turn determine the HLA binding capacity of the peptides in which they are present. (See, e.g., Madden, D. R. *Annu. Rev. Immunol.* 13:587, 1995; Smith, et al., *Immunity* 4:203, 1996; Fremont et al., *Immunity* 8:305, 1998; Stern et al., *Structure* 2:245, 1994; Jones, E. Y. *Curr. Opin. Immunol.* 9:75, 1997; Brown, J. H. et al., *Nature* 364:33, 1993; Guo, H. C. et al., *Proc. Natl. Acad. Sci. USA* 90:8053, 1993; Guo, H. C. et al., *Nature* 360:364, 1992; Silver, M. L. et al., *Nature* 360:367, 1992; Matsumura, M. et al., *Science* 257:927, 1992; Madden et al., *Cell* 70:1035, 1992; Fremont, D. H. et al., *Science* 257:919, 1992; Saper, M. A., Bjorkman, P. J. and Wiley, D. C., *J. Mol. Biol.* 219:277, 1991.)

Accordingly, the definition of class I and class II allele-specific HLA binding motifs, or class I or class II supermotifs allows identification of regions within a protein that are correlated with binding to particular HLA antigen(s).

Thus, by a process of HLA motif identification, candidates for epitope-based vaccines have been identified; such candidates can be further evaluated by HLA-peptide binding assays to determine binding affinity and/or the time period of association of the epitope and its corresponding HLA molecule. Additional confirmatory work can be performed to select, amongst these vaccine candidates, epitopes with preferred characteristics in terms of population coverage, and/or immunogenicity.

Various strategies can be utilized to evaluate cellular immunogenicity, including:

1) Evaluation of primary T cell cultures from normal individuals (see, e.g., Wentworth, P. A. et al., *Mol. Immunol.* 32:603, 1995; Celis, E. et al., *Proc. Natl. Acad. Sci. USA* 91:2105, 1994; Tsai, V. et al., *J. Immunol.* 158:1796, 1997; Kawashima, I. et al., *Human Immunol.* 59:1, 1998). This procedure involves the stimulation of peripheral blood lymphocytes (PBL) from normal subjects with a test peptide in the presence of antigen presenting cells in vitro over a period of several weeks. T cells specific for the peptide become activated during this time and are detected using, e.g., a lymphokine- or $^{51}$Cr-release assay involving peptide sensitized target cells.

2) Immunization of HLA transgenic mice (see, e.g., Wentworth, P. A. et al., *J. Immunol.* 26:97, 1996; Wentworth, P. A. et al., *Int. Immunol.* 8:651, 1996; Alexander, J. et al., *J. Immunol.* 159:4753, 1997). For example, in such methods peptides in incomplete Freund's adjuvant are administered subcutaneously to HLA transgenic mice. Several weeks following immunization, splenocytes are removed and cultured in vitro in the presence of test peptide for approximately one week. Peptide-specific T cells are detected using, e.g., a $^{51}$Cr-release assay involving peptide sensitized target cells and target cells expressing endogenously generated antigen.

3) Demonstration of recall T cell responses from immune individuals who have been either effectively vaccinated and/or from chronically ill patients (see, e.g., Rehermann, B. et al., *J. Exp. Med.* 181:1047, 1995; Doolan, D. L. et al., *Immunity* 7:97, 1997; Bertoni, R. et al., *J. Clin. Invest.* 100:503, 1997; Threlkeld, S. C. et al., *J. Immunol.* 159:1648, 1997; Diepolder, H. M. et al., *J. Virol.* 71:6011, 1997). Accordingly, recall responses are detected by culturing PBL from subjects that have been exposed to the antigen due to disease and thus have generated an immune response "naturally", or from patients who were vaccinated against the antigen. PBL from subjects are cultured in vitro for 1-2 weeks in the presence of test peptide plus antigen presenting cells (APC) to allow activation of "memory" T cells, as compared to "naive" T cells. At the end of the culture period, T cell activity is detected using assays including $^{51}$Cr release involving peptide-sensitized targets, T cell proliferation, or lymphokine release.

VI.) PSCA Transgenic Animals

Nucleic acids that encode a PSCA-related protein can also be used to generate either transgenic animals or "knock out" animals that, in turn, are useful in the development and screening of therapeutically useful reagents. In accordance with established techniques, cDNA encoding PSCA can be used to clone genomic DNA that encodes PSCA. The cloned genomic sequences can then be used to generate transgenic animals containing cells that express DNA that encode PSCA. Methods for generating transgenic animals, particularly animals such as mice or rats, have become conventional in the art and are described, for example, in U.S. Pat. No. 4,736,866 issued 12 Apr. 1988, and U.S. Pat. No. 4,870,009 issued 26 Sep. 1989. Typically, particular cells would be targeted for PSCA transgene incorporation with tissue-specific enhancers.

Transgenic animals that include a copy of a transgene encoding PSCA can be used to examine the effect of increased expression of DNA that encodes PSCA. Such animals can be used as tester animals for reagents thought to confer protection from, for example, pathological conditions associated with its overexpression. In accordance with this aspect of the invention, an animal is treated with a reagent and a reduced incidence of a pathological condition, compared to untreated animals that bear the transgene, would indicate a potential therapeutic intervention for the pathological condition.

Alternatively, non-human homologues of PSCA can be used to construct a PSCA "knock out" animal that has a defective or altered gene encoding PSCA as a result of homologous recombination between the endogenous gene encoding PSCA and altered genomic DNA encoding PSCA introduced into an embryonic cell of the animal. For example, cDNA that encodes PSCA can be used to clone genomic DNA encoding PSCA in accordance with established techniques. A portion of the genomic DNA encoding PSCA can be deleted or replaced with another gene, such as a gene encoding a selectable marker that can be used to monitor integration. Typically, several kilobases of unaltered flanking DNA (both at the 5' and 3' ends) are included in the vector (see, e.g., Thomas and Capecchi, Cell, 51:503 (1987) for a description of homologous recombination vectors). The vector is introduced into an embryonic stem cell line (e.g., by electroporation) and cells in which the introduced DNA has homologously recombined with the endogenous DNA are selected (see, e.g., Li et al, Cell, 69:915 (1992)). The selected cells are then injected into a blastocyst of an animal (e.g., a mouse or rat) to form aggregation chimeras (see, e.g., Bradley, in *Teratocarcinomas and Embryonic Stem Cells: A Practical Approach*, E. J. Robertson, ed. (IRL, Oxford, 1987), pp. 113-152). A chimeric embryo can then be implanted into a suitable pseudopregnant female foster animal, and the embryo brought to term to create a "knock out" animal. Progeny harboring the homologously recombined DNA in their germ cells can be identified by standard techniques and used to breed animals in which all cells of the animal contain the homologously recombined DNA. Knock out animals can be characterized, for example, for their ability to defend against certain pathological conditions or for their development of pathological conditions due to absence of a PSCA polypeptide.

VII.) Methods for the Detection of PSCA

Another aspect of the present invention relates to methods for detecting PSCA polynucleotides and PSCA-related proteins, as well as methods for identifying a cell that expresses PSCA. The expression profile of PSCA makes it a diagnostic marker for metastasized disease. Accordingly, the status of PSCA gene products provides information useful for predicting a variety of factors including susceptibility to advanced stage disease, rate of progression, and/or tumor aggressiveness. As discussed in detail herein, the status of PSCA gene products in patient samples can be analyzed by a variety protocols that are well known in the art including immunohistochemical analysis, the variety of Northern blotting techniques including in situ hybridization, RT-PCR analysis (for example on laser capture micro-dissected samples), Western blot analysis and tissue array analysis.

More particularly, the invention provides assays for the detection of PSCA polynucleotides in a biological sample, such as serum, bone, prostate, and other tissues, urine, semen, cell preparations, and the like. Detectable PSCA polynucleotides include, for example, a PSCA gene or fragment thereof, PSCA mRNA, alternative splice variant PSCA mRNAs, and recombinant DNA or RNA molecules that contain a PSCA polynucleotide. A number of methods for amplifying and/or detecting the presence of PSCA polynucleotides are well known in the art and can be employed in the practice of this aspect of the invention.

In one embodiment, a method for detecting a PSCA mRNA in a biological sample comprises producing cDNA from the sample by reverse transcription using at least one primer; amplifying the cDNA so produced using a PSCA polynucleotides as sense and antisense primers to amplify PSCA cDNAs therein; and detecting the presence of the amplified PSCA cDNA. Optionally, the sequence of the amplified PSCA cDNA can be determined.

In another embodiment, a method of detecting a PSCA gene in a biological sample comprises first isolating genomic DNA from the sample; amplifying the isolated genomic DNA using PSCA polynucleotides as sense and antisense primers; and detecting the presence of the amplified PSCA gene. Any number of appropriate sense and antisense probe combinations can be designed from a PSCA nucleotide sequence (see, e.g., FIG. 2) and used for this purpose.

The invention also provides assays for detecting the presence of a PSCA protein in a tissue or other biological sample such as serum, semen, bone, prostate, urine, cell preparations, and the like. Methods for detecting a PSCA-related protein are also well known and include, for example, immunoprecipitation, immunohistochemical analysis, Western blot analysis, molecular binding assays, ELISA, ELIFA and the like. For example, a method of detecting the presence of a PSCA-related protein in a biological sample comprises first contacting the sample with a PSCA antibody, a PSCA-reactive fragment thereof, or a recombinant protein containing an antigen-binding region of a PSCA antibody; and then detecting the binding of PSCA-related protein in the sample.

Methods for identifying a cell that expresses PSCA are also within the scope of the invention. In one embodiment, an assay for identifying a cell that expresses a PSCA gene comprises detecting the presence of PSCA mRNA in the cell. Methods for the detection of particular mRNAs in cells are well known and include, for example, hybridization assays using complementary DNA probes (such as in situ hybridization using labeled PSCA riboprobes, Northern blot and related techniques) and various nucleic acid amplification assays (such as RT-PCR using complementary primers specific for PSCA, and other amplification type detection methods, such as, for example, branched DNA, SISBA, TMA and the like). Alternatively, an assay for identifying a cell that expresses a PSCA gene comprises detecting the presence of PSCA-related protein in the cell or secreted by the cell. Various methods for the detection of proteins are well known in the art and are employed for the detection of PSCA-related proteins and cells that express PSCA-related proteins.

PSCA expression analysis is also useful as a tool for identifying and evaluating agents that modulate PSCA gene expression. For example, PSCA expression is significantly upregulated in prostate cancer, and is expressed in cancers of the tissues listed in Table I. Identification of a molecule or biological agent that inhibits PSCA expression or over-expression in cancer cells is of therapeutic value. For example, such an agent can be identified by using a screen that quantifies PSCA expression by RT-PCR, nucleic acid hybridization or antibody binding.

VIII.) Methods for Monitoring the Status of PSCA-related Genes and Their Products Oncogenesis is known to be a multistep process where cellular growth becomes progressively dysregulated and cells progress from a normal physiological state to precancerous and then cancerous states (see, e.g., Alers et at., Lab Invest. 77(5): 437-438 (1997) and Isaacs et at., Cancer Surv. 23: 19-32 (1995)). In this context, examining a biological sample for evidence of dysregulated cell growth (such as aberrant PSCA expression in cancers) allows for early detection of such aberrant physiology, before a pathologic state such as cancer has progressed to a stage that therapeutic options are more limited and or the prognosis is worse. In such examinations, the status of PSCA in a biological sample of interest can be compared, for example, to the status of PSCA in a corresponding normal sample (e.g. a sample from that individual or alternatively another individual that is not affected by a pathology). An alteration in the status of PSCA in the biological sample (as compared to the normal sample) provides evidence of dysregulated cellular growth. In addition to using a biological sample that is not affected by a pathology as a normal sample, one can also use a predetermined normative value such as a predetermined normal level of mRNA expression (see, e.g., Grever et al., J. Comp. Neurol. 1996 Dec. 9; 376(2): 306-14 and U.S. Pat. No. 5,837,501) to compare PSCA status in a sample.

The term "status" in this context is used according to its art accepted meaning and refers to the condition or state of a gene and its products. Typically, skilled artisans use a number of parameters to evaluate the condition or state of a gene and its products. These include, but are not limited to the location of expressed gene products (including the location of PSCA expressing cells) as well as the level, and biological activity of expressed gene products (such as PSCA mRNA, polynucleotides and polypeptides). Typically, an alteration in the status of PSCA comprises a change in the location of PSCA and/or PSCA expressing cells and/or an increase in PSCA mRNA and/or protein expression.

PSCA status in a sample can be analyzed by a number of means well known in the art, including without limitation, immunohistochemical analysis, in situ hybridization, RT-PCR analysis on laser capture micro-dissected samples, Western blot analysis, and tissue array analysis. Typical protocols for evaluating the status of a PSCA gene and gene products are found, for example in Ausubel et al. eds., 1995, Current Protocols In Molecular Biology, Units 2 (Northern Blotting), 4 (Southern Blotting), 15 (Immunoblotting) and 18 (PCR Analysis). Thus, the status of PSCA in a biological sample is evaluated by various methods utilized by skilled artisans including, but not limited to genomic Southern analysis (to examine, for example perturbations in a PSCA gene), Northern analysis and/or PCR analysis of PSCA mRNA (to examine, for example alterations in the polynucleotide sequences or expression levels of PSCA mRNAs), and, Western and/or immunohistochemical analysis (to examine, for example alterations in polypeptide sequences, alterations in polypeptide localization within a sample, alterations in expression levels of PSCA proteins and/or associations of PSCA proteins with polypeptide binding partners). Detectable PSCA polynucleotides include, for example, a PSCA gene or fragment thereof, PSCA mRNA, alternative splice variants, PSCA mRNAs, and recombinant DNA or RNA molecules containing a PSCA polynucleotide.

The expression profile of PSCA makes it a diagnostic marker for local and/or metastasized disease, and provides information on the growth or oncogenic potential of a biological sample. In particular, the status of PSCA provides information useful for predicting susceptibility to particular disease stages, progression, and/or tumor aggressiveness. The invention provides methods and assays for determining PSCA status and diagnosing cancers that express PSCA, such as cancers of the tissues listed in Table I. For example, because PSCA mRNA is so highly expressed in prostate and other cancers relative to normal prostate tissue, assays that evaluate the levels of PSCA mRNA transcripts or proteins in a biological sample can be used to diagnose a disease associated with PSCA dysregulation, and can provide prognostic information useful in defining appropriate therapeutic options.

The expression status of PSCA provides information including the presence, stage and location of dysplastic, precancerous and cancerous cells, predicting susceptibility to various stages of disease, and/or for gauging tumor aggressiveness. Moreover, the expression profile makes it useful as an imaging reagent for metastasized disease. Consequently, an aspect of the invention is directed to the various molecular prognostic and diagnostic methods for examining the status of PSCA in biological samples such as those from individuals suffering from, or suspected of suffering from a pathology characterized by dysregulated cellular growth, such as cancer.

As described above, the status of PSCA in a biological sample can be examined by a number of well-known procedures in the art. For example, the status of PSCA in a biological sample taken from a specific location in the body can be examined by evaluating the sample for the presence or absence of PSCA expressing cells (e.g. those that express PSCA mRNAs or proteins). This examination can provide evidence of dysregulated cellular growth, for example, when PSCA-expressing cells are found in a biological sample that does not normally contain such cells (such as a lymph node), because such alterations in the status of PSCA in a biological sample are often associated with dysregulated cellular growth. Specifically, one indicator of dysregulated cellular growth is the metastases of cancer cells from an organ of origin (such as the prostate) to a different area of the body (such as a lymph node). In this context, evidence of dysregulated cellular growth is important for example because occult lymph node metastases can be detected in a substantial proportion of patients with prostate cancer, and such metastases are associated with known predictors of disease progression (see, e.g., Murphy et al., Prostate 42(4): 315-317 (2000); Su et al., Semin. Surg. Oncol. 18(1): 17-28 (2000) and Freeman et al., J Urol 1995 August 154(2 Pt 1):474-8).

In one aspect, the invention provides methods for monitoring PSCA gene products by determining the status of PSCA gene products expressed by cells from an individual suspected of having a disease associated with dysregulated cell growth (such as hyperplasia or cancer) and then comparing the status so determined to the status of PSCA gene products in a corresponding normal sample. The presence of aberrant PSCA gene products in the test sample relative to the normal sample provides an indication of the presence of dysregulated cell growth within the cells of the individual.

In another aspect, the invention provides assays useful in determining the presence of cancer in an individual, comprising detecting a significant increase in PSCA mRNA or protein expression in a test cell or tissue sample relative to expression levels in the corresponding normal cell or tissue. The presence of PSCA mRNA can, for example, be evaluated in tissues including but not limited to those listed in Table I. The presence of significant PSCA expression in any of these tissues is useful to indicate the emergence, presence and/or severity of a cancer, since the corresponding normal tissues do not express PSCA mRNA or express it at lower levels.

In a related embodiment, PSCA status is determined at the protein level rather than at the nucleic acid level. For example, such a method comprises determining the level of PSCA protein expressed by cells in a test tissue sample and comparing the level so determined to the level of PSCA expressed in a corresponding normal sample. In one embodiment, the presence of PSCA protein is evaluated, for example, using immunohistochemical methods. PSCA antibodies or binding partners capable of detecting PSCA protein expression are used in a variety of assay formats well known in the art for this purpose.

In a further embodiment, one can evaluate the status of PSCA nucleotide and amino acid sequences in a biological sample in order to identify perturbations in the structure of these molecules. These perturbations can include insertions, deletions, substitutions and the like. Such evaluations are useful because perturbations in the nucleotide and amino acid sequences are observed in a large number of proteins associated with a growth dysregulated phenotype (see, e.g., Marrogi et al., 1999, J. Cutan. Pathol. 26(8):369-378). For example, a mutation in the sequence of PSCA may be indicative of the presence or promotion of a tumor. Such assays therefore have diagnostic and predictive value where a mutation in PSCA indicates a potential loss of function or increase in tumor growth.

A wide variety of assays for observing perturbations in nucleotide and amino acid sequences are well known in the art. For example, the size and structure of nucleic acid or amino acid sequences of PSCA gene products are observed by the Northern, Southern, Western, PCR and DNA sequencing protocols discussed herein. In addition, other methods for observing perturbations in nucleotide and amino acid sequences such as single strand conformation polymorphism analysis are well known in the art (see, e.g., U.S. Pat. No. 5,382,510 issued 7 Sep. 1999, and U.S. Pat. No. 5,952,170 issued 17 Jan. 1995).

Additionally, one can examine the methylation status of a PSCA gene in a biological sample. Aberrant demethylation and/or hypermethylation of CpG islands in gene 540 regulatory regions frequently occurs in immortalized and transformed cells, and can result in altered expression of various genes. For example, promoter hypermethylation of the pi-class glutathione S-transferase (a protein expressed in normal prostate but not expressed in >90% of prostate carcinomas) appears to permanently silence transcription of this gene and is the most frequently detected genomic alteration in prostate carcinomas (De Marzo et al., Am. J. Pathol. 155(6): 1985-1992 (1999)). In addition, this alteration is present in at least 70% of cases of high-grade prostatic intraepithelial neoplasia (PIN) (Brooks et al., Cancer Epidemiol. Biomarkers Prev., 1998, 7:531-536). In another example, expression of the LAGE-I tumor specific gene (which is not expressed in normal prostate but is expressed in 25-50% of prostate cancers) is induced by deoxy-azacytidine in lymphoblastoid cells, suggesting that tumoral expression is due to demethylation (Lethe et al., Int. J. Cancer 76(6): 903-908 (1998)). A variety of assays for examining methylation status of a gene are well known in the art. For example, one can utilize, in Southern hybridization approaches, methylation-sensitive restriction enzymes that cannot cleave sequences that contain methylated CpG sites to assess the methylation status of CpG islands. In addition, MSP (methylation specific PCR) can rapidly profile the methylation status of all the CpG sites present in a CpG island of a given gene. This procedure involves initial modification of DNA by sodium bisulfite (which will convert all unmethylated cytosines to uracil) followed by amplification using primers specific for methylated versus unmethylated DNA. Protocols involving methylation interference can also be found for example in Current Protocols In Molecular Biology, Unit 12, Frederick M. Ausubel et al. eds., 1995.

Gene amplification is an additional method for assessing the status of PSCA. Gene amplification is measured in a sample directly, for example, by conventional Southern blotting or Northern blotting to quantitate the transcription of mRNA (Thomas, 1980, Proc. Natl. Acad. Sci. USA, 77:5201-5205), dot blotting (DNA analysis), or in situ hybridization, using an appropriately labeled probe, based on the sequences provided herein. Alternatively, antibodies are employed that recognize specific duplexes, including DNA duplexes, RNA duplexes, and DNA-RNA hybrid duplexes or DNA-protein duplexes. The antibodies in turn are labeled and the assay carried out where the duplex is bound to a surface, so that upon the formation of duplex on the surface, the presence of antibody bound to the duplex can be detected.

Biopsied tissue or peripheral blood can be conveniently assayed for the presence of cancer cells using for example, Northern, dot blot or RT-PCR analysis to detect PSCA expression. The presence of RT-PCR amplifiable PSCA mRNA provides an indication of the presence of cancer. RT-PCR assays are well known in the art. RT-PCR detection assays for tumor cells in peripheral blood are currently being evaluated for use in the diagnosis and management of a number of human solid tumors. In the prostate cancer field, these include RT-PCR assays for the detection of cells expressing PSA and PSM (Verkaik et al., 1997, Urol. Res. 25:373-384; Ghossein et al., 1995, J. Clin. Oncol. 13:1195-2000; Heston et al., 1995, Clin. Chem. 41:1687-1688).

A further aspect of the invention is an assessment of the susceptibility that an individual has for developing cancer. In one embodiment, a method for predicting susceptibility to cancer comprises detecting PSCA mRNA or PSCA protein in a tissue sample, its presence indicating susceptibility to cancer, wherein the degree of PSCA mRNA expression correlates to the degree of susceptibility. In a specific embodiment, the presence of PSCA in prostate or other tissue is examined, with the presence of PSCA in the sample providing an indication of prostate cancer susceptibility (or the emergence or existence of a prostate tumor). Similarly, one can evaluate the integrity PSCA nucleotide and amino acid sequences in a biological sample, in order to identify perturbations in the structure of these molecules such as insertions, deletions, substitutions and the like. The presence of one or more perturbations in PSCA gene products in the sample is an indication of cancer susceptibility (or the emergence or existence of a tumor).

The invention also comprises methods for gauging tumor aggressiveness. In one embodiment, a method for gauging aggressiveness of a tumor comprises determining the level of PSCA mRNA or PSCA protein expressed by tumor cells, comparing the level so determined to the level of PSCA mRNA or PSCA protein expressed in a corresponding normal tissue taken from the same individual or a normal tissue reference sample, wherein the degree of PSCA mRNA or PSCA protein expression in the tumor sample relative to the normal sample indicates the degree of aggressiveness. In a specific embodiment, aggressiveness of a tumor is evaluated by determining the extent to which PSCA is expressed in the tumor cells, with higher expression levels indicating more aggressive tumors. Another embodiment is the evaluation of the integrity of PSCA nucleotide and amino acid sequences in a biological sample, in order to identify perturbations in the structure of these molecules such as insertions, deletions, substitutions and the like. The presence of one or more perturbations indicates more aggressive tumors.

Another embodiment of the invention is directed to methods for observing the progression of a malignancy in an individual over time. In one embodiment, methods for observing the progression of a malignancy in an individual over time comprise determining the level of PSCA mRNA or PSCA protein expressed by cells in a sample of the tumor, comparing the level so determined to the level of PSCA mRNA or PSCA protein expressed in an equivalent tissue sample taken from the same individual at a different time, wherein the degree of PSCA mRNA or PSCA protein expression in the tumor sample over time provides information on the progression of the cancer. In a specific embodiment, the progression of a cancer is evaluated by determining PSCA expression in the tumor cells over time, where increased expression over time indicates a progression of the cancer. Also, one can evaluate the integrity PSCA nucleotide and amino acid sequences in a biological sample in order to identify perturbations in the structure of these molecules such as insertions, deletions, substitutions and the like, where the presence of one or more perturbations indicates a progression of the cancer.

The above diagnostic approaches can be combined with any one of a wide variety of prognostic and diagnostic protocols known in the art. For example, another embodiment of the invention is directed to methods for observing a coincidence between the expression of PSCA gene and PSCA gene products (or perturbations in PSCA gene and PSCA gene products) and a factor that is associated with malignancy, as a means for diagnosing and prognosticating the status of a tissue sample. A wide variety of factors associated with malignancy can be utilized, such as the expression of genes associated with malignancy (e.g. PSA, PSCA and PSM expression for prostate cancer etc.) as well as gross cytological observations (see, e.g., Bocking et al., 1984, Anal. Quant. Cytol. 6(2):74-88; Epstein, 1995, Hum. Pathol. 26(2):223-9; Thorson et al., 1998, Mod. Pathol. 11(6):543-51; Baisden et al., 1999, Am. J. Surg. Pathol. 23(8):918-24). Methods for observing a coincidence between the expression of PSCA gene and PSCA gene products (or perturbations in PSCA gene and PSCA gene products) and another factor that is associated with malignancy are useful, for example, because the presence of a set of specific factors that coincide with disease provides information crucial for diagnosing and prognosticating the status of a tissue sample.

In one embodiment, methods for observing a coincidence between the expression of PSCA gene and PSCA gene products (or perturbations in PSCA gene and PSCA gene products) and another factor associated with malignancy entails detecting the overexpression of PSCA mRNA or protein in a tissue sample, detecting the overexpression of PSA mRNA or protein in a tissue sample (or PSCA or PSM expression), and observing a coincidence of PSCA mRNA or protein and PSA mRNA or protein overexpression (or PSCA or PSM expression). In a specific embodiment, the expression of PSCA and PSA mRNA in prostate tissue is examined, where the coincidence of PSCA and PSA mRNA overexpression in the sample indicates the existence of prostate cancer, prostate cancer susceptibility or the emergence or status of a prostate tumor.

Methods for detecting and quantifying the expression of PSCA mRNA or protein are described herein, and standard nucleic acid and protein detection and quantification technologies are well known in the art. Standard methods for the detection and quantification of PSCA mRNA include in situ hybridization using labeled PSCA riboprobes, Northern blot and related techniques using PSCA polynucleotide probes, RT-PCR analysis using primers specific for PSCA, and other amplification type detection methods, such as, for example, branched DNA, SISBA, TMA and the like. In a specific embodiment, semi-quantitative RT-PCR is used to detect and quantify PSCA mRNA expression. Any number of primers capable of amplifying PSCA can be used for this purpose, including but not limited to the various primer sets specifically described herein. In a specific embodiment, polyclonal or monoclonal antibodies specifically reactive with the wild-type PSCA protein can be used in an immunohistochemical assay of biopsied tissue.

IX.) Identification of Molecules That Interact With PSCA

The PSCA protein and nucleic acid sequences disclosed herein allow a skilled artisan to identify proteins, small molecules and other agents that interact with PSCA, as well as pathways activated by PSCA via any one of a variety of art accepted protocols. For example, one can utilize one of the so-called interaction trap systems (also referred to as the "two-hybrid assay"). In such systems, molecules interact and reconstitute a transcription factor which directs expression of a reporter gene, whereupon the expression of the reporter gene is assayed. Other systems identify protein-protein interactions in vivo through reconstitution of a eukaryotic transcriptional activator, see, e.g., U.S. Pat. No. 5,955,280 issued 21 Sep. 1999, U.S. Pat. No. 5,925,523 issued 20 Jul. 1999, U.S. Pat. No. 5,846,722 issued 8 Dec. 1998 and U.S. Pat. No. 6,004,746 issued 21 Dec. 1999. Algorithms are also available in the art for genome-based predictions of protein function (see, e.g., Marcotte, et al., Nature 402: 4 Nov. 1999, 83-86).

Alternatively one can screen peptide libraries to identify molecules that interact with PSCA protein sequences. In such methods, peptides that bind to PSCA are identified by screening libraries that encode a random or controlled collection of amino acids. Peptides encoded by the libraries are expressed as fusion proteins of bacteriophage coat proteins, the bacteriophage particles are then screened against the PSCA protein(s).

Accordingly, peptides having a wide variety of uses, such as therapeutic, prognostic or diagnostic reagents, are thus identified without any prior information on the structure of the expected ligand or receptor molecule. Typical peptide libraries and screening methods that can be used to identify molecules that interact with PSCA protein sequences are disclosed for example in U.S. Pat. No. 5,723,286 issued 3 Mar. 1998 and U.S. Pat. No. 5,733,731 issued 31 Mar. 1998.

Alternatively, cell lines that express PSCA are used to identify protein-protein interactions mediated by PSCA. Such interactions can be examined using immunoprecipitation techniques (see, e.g., Hamilton B. J., et al. Biochem.

Biophys. Res. Commun. 1999, 261:646-51). PSCA protein can be immunoprecipitated from PSCA-expressing cell lines using anti-PSCA antibodies. Alternatively, antibodies against His-tag can be used in a cell line engineered to express fusions of PSCA and a His-tag (vectors mentioned above). The immunoprecipitated complex can be examined for protein association by procedures such as Western blotting, $^{35}$S-methionine labeling of proteins, protein microsequencing, silver staining and two-dimensional gel electrophoresis.

Small molecules and ligands that interact with PSCA can be identified through related embodiments of such screening assays. For example, small molecules can be identified that interfere with protein function, including molecules that interfere with PSCA's ability to mediate phosphorylation and de-phosphorylation, interaction with DNA or RNA molecules as an indication of regulation of cell cycles, second messenger signaling or tumorigenesis. Similarly, small molecules that modulate PSCA-related ion channel, protein pump, or cell communication functions are identified and used to treat patients that have a cancer that expresses PSCA (see, e.g., Hille, B., Ionic Channels of Excitable Membranes $2^{nd}$ Ed., Sinauer Assoc., Sunderland, Mass., 1992). Moreover, ligands that regulate PSCA function can be identified based on their ability to bind PSCA and activate a reporter construct. Typical methods are discussed for example in U.S. Pat. No. 5,928,868 issued 27 Jul. 1999, and include methods for forming hybrid ligands in which at least one ligand is a small molecule. In an illustrative embodiment, cells engineered to express a fusion protein of PSCA and a DNA-binding protein are used to co-express a fusion protein of a hybrid ligand/small molecule and a cDNA library transcriptional activator protein. The cells further contain a reporter gene, the expression of which is conditioned on the proximity of the first and second fusion proteins to each other, an event that occurs only if the hybrid ligand binds to target sites on both hybrid proteins. Those cells that express the reporter gene are selected and the unknown small molecule or the unknown ligand is identified. This method provides a means of identifying modulators, which activate or inhibit PSCA.

An embodiment of this invention comprises a method of screening for a molecule that interacts with a PSCA amino acid sequence shown in FIG. 2 or FIG. 3, comprising the steps of contacting a population of molecules with a PSCA amino acid sequence, allowing the population of molecules and the PSCA amino acid sequence to interact under conditions that facilitate an interaction, determining the presence of a molecule that interacts with the PSCA amino acid sequence, and then separating molecules that do not interact with the PSCA amino acid sequence from molecules that do. In a specific embodiment, the method further comprises purifying, characterizing and identifying a molecule that interacts with the PSCA amino acid sequence. The identified molecule can be used to modulate a function performed by PSCA. In a preferred embodiment, the PSCA amino acid sequence is contacted with a library of peptides.

X.) Therapeutic Methods and Compositions

The identification of PSCA as a protein that is normally expressed in a restricted set of tissues, but which is also expressed in cancers such as those listed in Table I, opens a number of therapeutic approaches to the treatment of such cancers.

Of note, targeted antitumor therapies have been useful even when the targeted protein is expressed on normal tissues, even vital normal organ tissues. A vital organ is one that is necessary to sustain life, such as the heart or colon. A non-vital organ is one that can be removed whereupon the individual is still able to survive. Examples of non-vital organs are ovary, breast, and prostate.

For example, Herceptin® is an FDA approved pharmaceutical that has as its active ingredient an antibody which is immunoreactive with the protein variously known as HER2, HER2/neu, and erb-b-2. It is marketed by Genentech and has been a commercially successful antitumor agent. Herceptin sales reached almost $400 million in 2002. Herceptin is a treatment for HER2 positive metastatic breast cancer. However, the expression of HER2 is not limited to such tumors. The same protein is expressed in a number of normal tissues. In particular, it is known that HER2/neu is present in normal kidney and heart, thus these tissues are present in all human recipients of Herceptin. The presence of HER2/neu in normal kidney is also confirmed by Latif, Z., et al., *B.J.U. International* (2002) 89:5-9. As shown in this article (which evaluated whether renal cell carcinoma should be a preferred indication for anti-HER2 antibodies such as Herceptin) both protein and mRNA are produced in benign renal tissues. Notably, HER2/neu protein was strongly overexpressed in benign renal tissue.

Despite the fact that HER2/neu is expressed in such vital tissues as heart and kidney, Herceptin is a very useful, FDA approved, and commercially successful drug. The effect of Herceptin on cardiac tissue, i.e., "cardiotoxicity," has merely been a side effect to treatment. When patients were treated with Herceptin alone, significant cardiotoxicity occurred in a very low percentage of patients.

Of particular note, although kidney tissue is indicated to exhibit normal expression, possibly even higher expression than cardiac tissue, kidney has no appreciable Herceptin side effect whatsoever. Moreover, of the diverse array of normal tissues in which HER2 is expressed, there is very little occurrence of any side effect. Only cardiac tissue has manifested any appreciable side effect at all. A tissue such as kidney, where HER2/neu expression is especially notable, has not been the basis for any side effect.

Furthermore, favorable therapeutic effects have been found for antitumor therapies that target epidermal growth factor receptor (EGFR). EGFR is also expressed in numerous normal tissues. There have been very limited side effects in normal tissues following use of anti-EGFR therapeutics.

Thus, expression of a target protein in normal tissue, even vital normal tissue, does not defeat the utility of a targeting agent for the protein as a therapeutic for certain tumors in which the protein is also overexpressed.

Accordingly, therapeutic approaches that inhibit the activity of a PSCA protein are useful for patients suffering from a cancer that expresses PSCA. These therapeutic approaches generally fall into two classes. One class comprises various methods for inhibiting the binding or association of a PSCA protein with its binding partner or with other proteins. Another class comprises a variety of methods for inhibiting the transcription of a PSCA gene or translation of PSCA mRNA.

X.A.) Anti-Cancer Vaccines

The invention provides cancer vaccines comprising a PSCA-related protein or PSCA-related nucleic acid. In view of the expression of PSCA, cancer vaccines prevent and/or treat PSCA-expressing cancers with minimal or no effects on non-target tissues. The use of a tumor antigen in a vaccine that generates humoral and/or cell-mediated immune responses as anti-cancer therapy is well known in the art and has been employed in prostate cancer using human PSMA and rodent PAP immunogens (Hodge et al., 1995, Int. J. Cancer 63:231-237; Fong et al., 1997, J. Immunol. 159:3113-3117).

Such methods can be readily practiced by employing a PSCA-related protein, or a PSCA-encoding nucleic acid molecule and recombinant vectors capable of expressing and presenting the PSCA immunogen (which typically comprises a number of antibody or T cell epitopes). Skilled artisans understand that a wide variety of vaccine systems for delivery of immunoreactive epitopes are known in the art (see, e.g., Heryln et al., Ann Med 1999 Feb. 31(1):66-78; Maruyama et al., Cancer Immunol Immunother 2000 June 49(3):123-32) Briefly, such methods of generating an immune response (e.g. humoral and/or cell-mediated) in a mammal, comprise the steps of: exposing the mammal's immune system to an immunoreactive epitope (e.g. an epitope present in a PSCA protein shown in FIG. 3 or analog or homolog thereof) so that the mammal generates an immune response that is specific for that epitope (e.g. generates antibodies that specifically recognize that epitope). In a preferred method, a PSCA immunogen contains a biological motif, see e.g., Tables VIII-XXI and XXII-XLIX, or a peptide of a size range from PSCA indicated in FIG. 5, FIG. 6, FIG. 7, FIG. 8, and FIG. 9.

The entire PSCA protein, immunogenic regions or epitopes thereof can be combined and delivered by various means. Such vaccine compositions can include, for example, lipopeptides (e.g., Vitiello, A. et al., *J. Clin. Invest.* 95:341, 1995), peptide compositions encapsulated in poly(DL-lactide-co-glycolide) ("PLG") microspheres (see, e.g., Eldridge, et al., *Molec. Immunol.* 28:287-294, 1991: Alonso et al., *Vaccine* 12:299-306, 1994; Jones et al., *Vaccine* 13:675-681, 1995), peptide compositions contained in immune stimulating complexes (ISCOMS) (see, e.g., Takahashi et al., *Nature* 344:873-875, 1990; Hu et al., *Clin Exp Immunol.* 113:235-243, 1998), multiple antigen peptide systems (MAPs) (see e.g., Tam, J. P., *Proc. Natl. Acad. Sci. U.S.A.* 85:5409-5413, 1988; Tam, J. P., *J. Immunol. Methods* 196:17-32, 1996), peptides formulated as multivalent peptides; peptides for use in ballistic delivery systems, typically crystallized peptides, viral delivery vectors (Perkus, M. E. et al., In: *Concepts in vaccine development*, Kaufmann, S. H. E., ed., p. 379, 1996; Chakrabarti, S. et al., *Nature* 320:535, 1986; Hu, S. L. et al., *Nature* 320:537, 1986; Kieny, M.-P. et al., *AIDS Bio/Technology* 4:790, 1986; Top, F. H. et al., *J. Infect. Dis.* 124:148, 1971; Chanda, P. K. et al., *Virology* 175:535, 1990), particles of viral or synthetic origin (e.g., Kofler, N. et al., *J. Immunol. Methods.* 192:25, 1996; Eldridge, J. H. et al., *Sem. Hematol.* 30:16, 1993; Falo, L. D., Jr. et al., *Nature Med.* 7:649, 1995), adjuvants (Warren, H. S., Vogel, F. R., and Chedid, L. A. *Annu. Rev. Immunol.* 4:369, 1986; Gupta, R. K. et al., *Vaccine* 11:293, 1993), liposomes (Reddy, R. et al., *J. Immunol.* 148:1585, 1992; Rock, K. L., *Immunol. Today* 17:131, 1996), or, naked or particle absorbed cDNA (Ulmer, J. B. et al., *Science* 259:1745, 1993; Robinson, H. L., Hunt, L. A., and Webster, R. G., *Vaccine* 11:957, 1993; Shiver, J. W. et al, In: *Concepts in vaccine development*, Kaufmann, S. H. E., ed., p. 423, 1996; Cease, K. B., and Berzofsky, J. A., *Annu. Rev. Immunol.* 12:923, 1994 and Eldridge, J. H. et al., *Sem. Hematol.* 30:16, 1993). Toxin-targeted delivery technologies, also known as receptor mediated targeting, such as those of Avant Immunotherapeutics, Inc. (Needham, Mass.) may also be used.

In patients with PSCA-associated cancer, the vaccine compositions of the invention can also be used in conjunction with other treatments used for cancer, e.g., surgery, chemotherapy, drug therapies, radiation therapies, etc. including use in combination with immune adjuvants such as IL-2, IL-12, GM-CSF, and the like.

Cellular Vaccines:

CTL epitopes can be determined using specific algorithms to identify peptides within PSCA protein that bind corresponding HLA alleles (see e.g., Table IV; Epimer™ and Epimatrix™, Brown University (URL brown.edu/Research/TB-HIV_Lab/epimatrix/epimatrix.html); and, BIMAS, (URL bimas.dcrt.nih.gov/; SYFPEITHI at URL syfpeithi.bmi-heidelberg.com/). In a preferred embodiment, a PSCA immunogen contains one or more amino acid sequences identified using techniques well known in the art, such as the sequences shown in Tables VIII-XXI and XXII-XLIX or a peptide of 8, 9, 10 or 11 amino acids specified by an HLA Class I motif/ supermotif (e.g., Table IV (A), Table IV (D), or Table IV (E)) and/or a peptide of at least 9 amino acids that comprises an HLA Class II motif/supermotif (e.g., Table IV (B) or Table IV (C)). As is appreciated in the art, the HLA Class I binding groove is essentially closed ended so that peptides of only a particular size range can fit into the groove and be bound, generally HLA Class I epitopes are 8, 9, 10, or 11 amino acids long. In contrast, the HLA Class II binding groove is essentially open ended; therefore a peptide of about 9 or more amino acids can be bound by an HLA Class II molecule. Due to the binding groove differences between HLA Class I and II, HLA Class I motifs are length specific, i.e., position two of a Class I motif is the second amino acid in an amino to carboxyl direction of the peptide. The amino acid positions in a Class II motif are relative only to each other, not the overall peptide, i.e., additional amino acids can be attached to the amino and/or carboxyl termini of a motif-bearing sequence. HLA Class II epitopes are often 9, 10, 11, 12, 13, 14, 15, 16, 17, 18, 19, 20, 21, 22, 23, 24, or 25 amino acids long, or longer than 25 amino acids.

Antibody-based Vaccines

A wide variety of methods for generating an immune response in a mammal are known in the art (for example as the first step in the generation of hybridomas). Methods of generating an immune response in a mammal comprise exposing the mammal's immune system to an immunogenic epitope on a protein (e.g. a PSCA protein) so that an immune response is generated. A typical embodiment consists of a method for generating an immune response to PSCA in a host, by contacting the host with a sufficient amount of at least one PSCA B cell or cytotoxic T-cell epitope or analog thereof; and at least one periodic interval thereafter re-contacting the host with the PSCA B cell or cytotoxic T-cell epitope or analog thereof. A specific embodiment consists of a method of generating an immune response against a PSCA-related protein or a man-made multiepitopic peptide comprising: administering PSCA immunogen (e.g. a PSCA protein or a peptide fragment thereof, a PSCA fusion protein or analog etc.) in a vaccine preparation to a human or another mammal. Typically, such vaccine preparations further contain a suitable adjuvant (see, e.g., U.S. Pat. No. 6,146,635) or a universal helper epitope such as a PADRE™ peptide (Epimmune Inc., San Diego, Calif.; see, e.g., Alexander et al., J. Immunol. 2000 164(3); 164(3): 1625-1633; Alexander et al., Immunity 1994 1(9): 751-761 and Alexander et al., Immunol. Res. 1998 18(2): 79-92). An alternative method comprises generating an immune response in an individual against a PSCA immunogen by: administering in vivo to muscle or skin of the individual's body a DNA molecule that comprises a DNA sequence that encodes a PSCA immunogen, the DNA sequence operatively linked to regulatory sequences which control the expression of the DNA sequence; wherein the DNA molecule is taken up by cells, the DNA sequence is expressed in the cells and an immune response is generated against the immunogen (see, e.g., U.S. Pat. No. 5,962,428). Optionally a genetic vaccine facilitator such as anionic lipids; saponins; lectins; estrogenic compounds; hydroxylated lower alkyls; dimethyl sulfoxide; and urea is also administered. In addition, an antiidiotypic antibody can be administered that mimics PSCA, in order to generate a response to the target antigen.

Nucleic Acid Vaccines:

Vaccine compositions of the invention include nucleic acid-mediated modalities. DNA or RNA that encode protein (s) of the invention can be administered to a patient. Genetic immunization methods can be employed to generate prophylactic or therapeutic humoral and cellular immune responses directed against cancer cells expressing PSCA. Constructs comprising DNA encoding a PSCA-related protein/immunogen and appropriate regulatory sequences can be injected directly into muscle or skin of an individual, such that the cells of the muscle or skin take-up the construct and express the encoded PSCA protein/immunogen. Alternatively, a vaccine comprises a PSCA-related protein. Expression of the PSCA-related protein immunogen results in the generation of prophylactic or therapeutic humoral and cellular immunity against cells that bear a PSCA protein. Various prophylactic and therapeutic genetic immunization techniques known in the art can be used (for review, see information and references published at Internet address genweb.com). Nucleic acid-based delivery is described, for instance, in Wolff et al., *Science* 247:1465 (1990) as well as U.S. Pat. Nos. 5,580,859; 5,589,466; 5,804,566; 5,739,118; 5,736,524; 5,679,647; WO 98/04720. Examples of DNA-based delivery technologies include "naked DNA", facilitated (bupivicaine, polymers, peptide-mediated) delivery, cationic lipid complexes, and particle-mediated ("gene gun") or pressure-mediated delivery (see, e.g., U.S. Pat. No. 5,922,687).

For therapeutic or prophylactic immunization purposes, proteins of the invention can be expressed via viral or bacterial vectors. Various viral gene delivery systems that can be used in the practice of the invention include, but are not limited to, vaccinia, fowlpox, canarypox, adenovirus, influenza, poliovirus, adeno-associated virus, lentivirus, and sindbis virus (see, e.g., Restifo, 1996, Curr. Opin. Immunol. 8:658-663; Tsang et al. J. Natl. Cancer Inst. 87:982-990 (1995)). Non-viral delivery systems can also be employed by introducing naked DNA encoding a PSCA-related protein into the patient (e.g., intramuscularly or intradermally) to induce an anti-tumor response.

Vaccinia virus is used, for example, as a vector to express nucleotide sequences that encode the peptides of the invention. Upon introduction into a host, the recombinant vaccinia virus expresses the protein immunogenic peptide, and thereby elicits a host immune response. Vaccinia vectors and methods useful in immunization protocols are described in, e.g., U.S. Pat. No. 4,722,848. Another vector is BCG (Bacille Calmette Guerin). BCG vectors are described in Stover et al., *Nature* 351:456-460 (1991). A wide variety of other vectors useful for therapeutic administration or immunization of the peptides of the invention, e.g. adeno and adeno-associated virus vectors, retroviral vectors, Salmonella typhi vectors, detoxified anthrax toxin vectors, and the like, will be apparent to those skilled in the art from the description herein.

Thus, gene delivery systems are used to deliver a PSCA-related nucleic acid molecule. In one embodiment, the full-length human PSCA cDNA is employed. In another embodiment, PSCA nucleic acid molecules encoding specific cytotoxic T lymphocyte (CTL) and/or antibody epitopes are employed.

Ex Vivo Vaccines

Various ex vivo strategies can also be employed to generate an immune response. One approach involves the use of antigen presenting cells (APCs) such as dendritic cells (DC) to present PSCA antigen to a patient's immune system. Dendritic cells express MHC class I and II molecules, B7 co-stimulator, and IL-12, and are thus highly specialized antigen presenting cells. In prostate cancer, autologous dendritic cells pulsed with peptides of the prostate-specific membrane antigen (PSMA) are being used in a Phase I clinical trial to stimulate prostate cancer patients' immune systems (Tjoa et al., 1996, Prostate 28:65-69; Murphy et al., 1996, Prostate 29:371-380). Thus, dendritic cells can be used to present PSCA peptides to T cells in the context of MHC class I or II molecules. In one embodiment, autologous dendritic cells are pulsed with PSCA peptides capable of binding to MHC class I and/or class II molecules. In another embodiment, dendritic cells are pulsed with the complete PSCA protein. Yet another embodiment involves engineering the overexpression of a PSCA gene in dendritic cells using various implementing vectors known in the art, such as adenovirus (Arthur et al., 1997, Cancer Gene Ther. 4:17-25), retrovirus (Henderson et al., 1996, Cancer Res. 56:3763-3770), lentivirus, adeno-associated virus, DNA transfection (Ribas et al., 1997, Cancer Res. 57:2865-2869), or tumor-derived RNA transfection (Ashley et al., 1997, J. Exp. Med. 186:1177-1182). Cells that express PSCA can also be engineered to express immune modulators, such as GM-CSF, and used as immunizing agents.

X.B.) PSCA as a Target for Antibody-based Therapy

511582008800able the use of reduced dosages of concomitant chemotherapy, particularly for patients who do not tolerate the toxicity of the chemotherapeutic agent very well.

Cancer patients can be evaluated for the presence and level of PSCA expression, preferably using immunohistochemical assessments of tumor tissue, quantitative PSCA imaging, or other techniques that reliably indicate the presence and degree of PSCA expression. Immunohistochemical analysis of tumor biopsies or surgical specimens is preferred for this purpose. Methods for immunohistochemical analysis of tumor tissues are well known in the art.

Anti-PSCA monoclonal antibodies that treat prostate and other cancers include those that initiate a potent immune response against the tumor or those that are directly cytotoxic. In this regard, anti-PSCA monoclonal antibodies (mAbs) can elicit tumor cell lysis by either complement-mediated or antibody-dependent cell cytotoxicity (ADCC) mechanisms, both of which require an intact Fc portion of the immunoglobulin molecule for interaction with effector cell Fc receptor sites on complement proteins. In addition, anti-PSCA mAbs that exert a direct biological effect on tumor growth are useful to treat cancers that express PSCA. Mechanisms by which directly cytotoxic mAbs act include: inhibition of cell growth, modulation of cellular differentiation, modulation of tumor angiogenesis factor profiles, and the induction of apoptosis. The mechanism(s) by which a particular anti-PSCA mAb exerts an anti-tumor effect is evaluated using any number of in vitro assays that evaluate cell death such as ADCC, ADMMC, complement-mediated cell lysis, and so forth, as is generally known in the art.

In some patients, the use of murine or other non-human monoclonal antibodies, or human/mouse chimeric mAbs can induce moderate to strong immune responses against the non-human antibody. This can result in clearance of the antibody from circulation and reduced efficacy. In the most severe cases, such an immune response can lead to the extensive formation of immune complexes which, potentially, can cause renal failure. Accordingly, preferred monoclonal antibodies used in the therapeutic methods of the invention are those that are either fully human or humanized and that bind specifically to the target PSCA antigen with high affinity but exhibit low or no antigenicity in the patient.

Therapeutic methods of the invention contemplate the administration of single anti-PSCA mAbs as well as combinations, or cocktails, of different mAbs. Such mAb cocktails can have certain advantages inasmuch as they contain mAbs that target different epitopes, exploit different effector mechanisms or combine directly cytotoxic mAbs with mAbs that rely on immune effector functionality. Such mAbs in combination can exhibit synergistic therapeutic effects. In addition, anti-PSCA mAbs can be administered concomitantly with other therapeutic modalities, including but not limited to various chemotherapeutic agents, androgen-blockers, immune modulators (e.g., IL-2, GM-CSF), surgery or radiation. The anti-PSCA mAbs are administered in their "naked" or unconjugated form, or can have a therapeutic agent(s) conjugated to them.

Anti-PSCA antibody formulations are administered via any route capable of delivering the antibodies to a tumor cell. Routes of administration include, but are not limited to, intravenous, intraperitoneal, intramuscular, intratumor, intradermal, and the like. Treatment generally involves repeated administration of the anti-PSCA antibody preparation, via an acceptable route of administration such as intravenous injection (IV), typically at a dose in the range of about 0.1, 0.2, 0.3, 0.4, 0.5, 0.6, 0.7, 0.8, 0.9., 1, 2, 3, 4, 5, 6, 7, 8, 9, 10, 15, 20, or 25 mg/kg body weight. In general, doses in the range of 10-1000 mg mAb per week are effective and well tolerated.

Based on clinical experience with the Herceptin™ mAb in the treatment of metastatic breast cancer, an initial loading dose of approximately 4 mg/kg patient body weight IV, followed by weekly doses of about 2 mg/kg IV of the anti-PSCA mAb preparation represents an acceptable dosing regimen. Preferably, the initial loading dose is administered as a 90-minute or longer infusion. The periodic maintenance dose is administered as a 30 minute or longer infusion, provided the initial dose was well tolerated. As appreciated by those of skill in the art, various factors can influence the ideal dose regimen in a particular case. Such factors include, for example, the binding affinity and half life of the Ab or mAbs used, the degree of PSCA expression in the patient, the extent of circulating shed PSCA antigen, the desired steady-state antibody concentration level, frequency of treatment, and the influence of chemotherapeutic or other agents used in combination with the treatment method of the invention, as well as the health status of a particular patient.

Optionally, patients should be evaluated for the levels of PSCA in a given sample (e.g. the levels of circulating PSCA antigen and/or PSCA expressing cells) in order to assist in the determination of the most effective dosing regimen, etc. Such evaluations are also used for monitoring purposes throughout therapy, and are useful to gauge therapeutic success in combination with the evaluation of other parameters (for example, urine cytology and/or ImmunoCyt levels in bladder cancer therapy, or by analogy, serum PSA levels in prostate cancer therapy).

Anti-idiotypic anti-PSCA antibodies can also be used in anti-cancer therapy as a vaccine for inducing an immune response to cells expressing a PSCA-related protein. In particular, the generation of anti-idiotypic antibodies is well known in the art; this methodology can readily be adapted to generate anti-idiotypic anti-PSCA antibodies that mimic an epitope on a PSCA-related protein (see, for example, Wagner et al., 1997, Hybridoma 16: 33-40; Foon et al., 1995, J. Clin. Invest. 96:334-342; Herlyn et al., 1996, Cancer Immunol. Immunother. 43:65-76). Such an anti-idiotypic antibody can be used in cancer vaccine strategies.

X.C.) PSCA as a Target for Cellular Immune Responses

Vaccines and methods of preparing vaccines that contain an immunogenically effective amount of one or more HLA-binding peptides as described herein are further embodiments of the invention. Furthermore, vaccines in accordance with the invention encompass compositions of one or more of the claimed peptides. A peptide can be present in a vaccine individually. Alternatively, the peptide can exist as a homopolymer comprising multiple copies of the same peptide, or as a heteropolymer of various peptides. Polymers have the advantage of increased immunological reaction and, where different peptide epitopes are used to make up the polymer, the additional ability to induce antibodies and/or CTLs that react with different antigenic determinants of the pathogenic organism or tumor-related peptide targeted for an immune response. The composition can be a naturally occurring region of an antigen or can be prepared, e.g., recombinantly or by chemical synthesis.

Carriers that can be used with vaccines of the invention are well known in the art, and include, e.g., thyroglobulin, albumins such as human serum albumin, tetanus toxoid, polyamino acids such as poly L-lysine, poly L-glutamic acid, influenza, hepatitis B virus core protein, and the like. The vaccines can contain a physiologically tolerable (i.e., acceptable) diluent such as water, or saline, preferably phosphate buffered saline. The vaccines also typically include an adjuvant. Adjuvants such as incomplete Freund's adjuvant, aluminum phosphate, aluminum hydroxide, or alum are examples of materials well known in the art. Additionally, as disclosed herein, CTL responses can be primed by conjugating peptides of the invention to lipids, such as tripalmitoyl-S-glycerylcysteinlyseryl-serine ($P_3CSS$). Moreover, an adjuvant such as a synthetic cytosine-phosphorothiolated-guanine-containing (CpG) oligonucleotides has been found to increase CTL responses 10- to 100-fold. (see, e.g. Davila and Celis, J. Immunol. 165:539-547 (2000))

Upon immunization with a peptide composition in accordance with the invention, via injection, aerosol, oral, transdermal, transmucosal, intrapleural, intrathecal, or other suitable routes, the immune system of the host responds to the vaccine by producing large amounts of CTLs and/or HTLs specific for the desired antigen. Consequently, the host becomes at least partially immune to later development of cells that express or overexpress PSCA antigen, or derives at least some therapeutic benefit when the antigen was tumor-associated.

In some embodiments, it may be desirable to combine the class I peptide components with components that induce or facilitate neutralizing antibody and or helper T cell responses directed to the target antigen. A preferred embodiment of such a composition comprises class I and class II epitopes in accordance with the invention. An alternative embodiment of such a composition comprises a class I and/or class II epitope in accordance with the invention, along with a cross reactive HTL epitope such as PADRE™ (Epimmune, San Diego, Calif.) molecule (described e.g., in U.S. Pat. No. 5,736,142).

A vaccine of the invention can also include antigen-presenting cells (APC), such as dendritic cells (DC), as a vehicle to present peptides of the invention. Vaccine compositions can be created in vitro, following dendritic cell mobilization and harvesting, whereby loading of dendritic cells occurs in vitro. For example, dendritic cells are transfected, e.g., with a minigene in accordance with the invention, or are pulsed with peptides. The dendritic cell can then be administered to a patient to elicit immune responses in vivo. Vaccine compositions, either DNA- or peptide-based, can also be administered in vivo in combination with dendritic cell mobilization whereby loading of dendritic cells occurs in vivo.

Preferably, the following principles are utilized when selecting an array of epitopes for inclusion in a polyepitopic composition for use in a vaccine, or for selecting discrete epitopes to be included in a vaccine and/or to be encoded by nucleic acids such as a minigene. It is preferred that each of the following principles be balanced in order to make the selection. The multiple epitopes to be incorporated in a given vaccine composition may be, but need not be, contiguous in sequence in the native antigen from which the epitopes are derived.

1.) Epitopes are selected which, upon administration, mimic immune responses that have been observed to be correlated with tumor clearance. For HLA Class I this includes 3-4 epitopes that come from at least one tumor associated antigen (TAA). For HLA Class II a similar rationale is employed; again 3-4 epitopes are selected from at least one TAA (see, e.g., Rosenberg et al., *Science* 278:1447-1450). Epitopes from one TAA may be used in combination with epitopes from one or more additional TAAs to produce a vaccine that targets tumors with varying expression patterns of frequently-expressed TAAs.

2.) Epitopes are selected that have the requisite binding affinity established to be correlated with immunogenicity: for HLA Class I an $IC_{50}$ of 500 nM or less, often 200 nM or less; and for Class II an $IC_{50}$ of 1000 nM or less.

3.) Sufficient supermotif bearing-peptides, or a sufficient array of allele-specific motif-bearing peptides, are selected to give broad population coverage. For example, it is preferable to have at least 80% population coverage. A Monte Carlo analysis, a statistical evaluation known in the art, can be employed to assess the breadth, or redundancy of, population coverage.

4.) When selecting epitopes from cancer-related antigens it is often useful to select analogs because the patient may have developed tolerance to the native epitope.

5.) Of particular relevance are epitopes referred to as "nested epitopes." Nested epitopes occur where at least two epitopes overlap in a given peptide sequence. A nested peptide sequence can comprise B cell, HLA class I and/or HLA class II epitopes. When providing nested epitopes, a general objective is to provide the greatest number of epitopes per sequence. Thus, an aspect is to avoid providing a peptide that is any longer than the amino terminus of the amino terminal epitope and the carboxyl terminus of the carboxyl terminal epitope in the peptide. When providing a multi-epitopic sequence, such as a sequence comprising nested epitopes, it is generally important to screen the sequence in order to insure that it does not have pathological or other deleterious biological properties.

6.) If a polyepitopic protein is created, or when creating a minigene, an objective is to generate the smallest peptide that encompasses the epitopes of interest. This principle is similar, if not the same as that employed when selecting a peptide comprising nested epitopes. However, with an artificial polyepitopic peptide, the size minimization objective is balanced against the need to integrate any spacer sequences between epitopes in the polyepitopic protein. Spacer amino acid residues can, for example, be introduced to avoid junctional epitopes (an epitope recognized by the immune system, not present in the target antigen, and only created by the man-made juxtaposition of epitopes), or to facilitate cleavage between epitopes and thereby enhance epitope presentation. Junctional epitopes are generally to be avoided because the recipient may generate an immune response to that non-native epitope. Of particular concern is a junctional epitope that is a "dominant epitope." A dominant epitope may lead to such a zealous response that immune responses to other epitopes are diminished or suppressed.

7.) Where the sequences of multiple variants of the same target protein are present, potential peptide epitopes can also be selected on the basis of their conservancy. For example, a criterion for conservancy may define that the entire sequence of an HLA class I binding peptide or the entire 9-mer core of a class II binding peptide be conserved in a designated percentage of the sequences evaluated for a specific protein antigen.

X.C.1. Minigene Vaccines

A number of different approaches are available which allow simultaneous delivery of multiple epitopes. Nucleic acids encoding the peptides of the invention are a particularly useful embodiment of the invention. Epitopes for inclusion in a minigene are preferably selected according to the guidelines set forth in the previous section. A preferred means of administering nucleic acids encoding the peptides of the invention uses minigene constructs encoding a peptide comprising one or multiple epitopes of the invention.

The use of multi-epitope minigenes is described below and in, Ishioka et al., *J. Immunol.* 162:3915-3925, 1999; An, L. and Whitton, J. L., *J. Virol.* 71:2292, 1997; Thomson, S. A. et al., *J. Immunol.* 157:822, 1996; Whitton, J. L. et al., *J. Virol.* 67:348, 1993; Hanke, R. et al., *Vaccine* 16:426, 1998. For example, a multi-epitope DNA plasmid encoding supermotif- and/or motif-bearing epitopes derived PSCA, the PADRE® universal helper T cell epitope or multiple HTL epitopes from PSCA (see e.g., Tables VIII-XXI and XXII to XLIX), and an endoplasmic reticulum-translocating signal sequence can be engineered. A vaccine may also comprise epitopes that are derived from other TAAs.

The immunogenicity of a multi-epitopic minigene can be confirmed in transgenic mice to evaluate the magnitude of CTL induction responses against the epitopes tested. Further, the immunogenicity of DNA-encoded epitopes in vivo can be correlated with the in vitro responses of specific CTL lines against target cells transfected with the DNA plasmid. Thus, these experiments can show that the minigene serves to both: 1.) generate a CTL response and 2.) that the induced CTLs recognized cells expressing the encoded epitopes.

For example, to create a DNA sequence encoding the selected epitopes (minigene) for expression in human cells, the amino acid sequences of the epitopes may be reverse translated. A human codon usage table can be used to guide the codon choice for each amino acid. These epitope-encoding DNA sequences may be directly adjoined, so that when translated, a continuous polypeptide sequence is created. To optimize expression and/or immunogenicity, additional elements can be incorporated into the minigene design. Examples of amino acid sequences that can be reverse translated and included in the minigene sequence include: HLA class I epitopes, HLA class II epitopes, antibody epitopes, a ubiquitination signal sequence, and/or an endoplasmic reticulum targeting signal. In addition, HLA presentation of CTL and HTL epitopes may be improved by including synthetic (e.g. poly-alanine) or naturally-occurring flanking sequences adjacent to the CTL or HTL epitopes; these larger peptides comprising the epitope(s) are within the scope of the invention.

The minigene sequence may be converted to DNA by assembling oligonucleotides that encode the plus and minus strands of the minigene. Overlapping oligonucleotides (30-100 bases long) may be synthesized, phosphorylated, purified and annealed under appropriate conditions using well known techniques. The ends of the oligonucleotides can be joined, for example, using T4 DNA ligase. This synthetic minigene, encoding the epitope polypeptide, can then be cloned into a desired expression vector.

Standard regulatory sequences well known to those of skill in the art are preferably included in the vector to ensure expression in the target cells. Several vector elements are desirable: a promoter with a downstream cloning site for minigene insertion; a polyadenylation signal for efficient transcription termination; an E. coli origin of replication; and an E. coli selectable marker (e.g. ampicillin or kanamycin resistance). Numerous promoters can be used for this purpose, e.g., the human cytomegalovirus (hCMV) promoter. See, e.g., U.S. Pat. Nos. 5,580,859 and 5,589,466 for other suitable promoter sequences.

Additional vector modifications may be desired to optimize minigene expression and immunogenicity. In some cases, introns are required for efficient gene expression, and one or more synthetic or naturally-occurring introns could be incorporated into the transcribed region of the minigene. The inclusion of mRNA stabilization sequences and sequences for replication in mammalian cells may also be considered for increasing minigene expression.

Once an expression vector is selected, the minigene is cloned into the polylinker region downstream of the promoter. This plasmid is transformed into an appropriate E. coli strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as a master cell bank and a working cell bank.

In addition, immunostimulatory sequences (ISSs or CpGs) appear to play a role in the immunogenicity of DNA vaccines. These sequences may be included in the vector, outside the minigene coding sequence, if desired to enhance immunogenicity.

In some embodiments, a bi-cistronic expression vector which allows production of both the minigene-encoded epitopes and a second protein (included to enhance or decrease immunogenicity) can be used. Examples of proteins or polypeptides that could beneficially enhance the immune response if co-expressed include cytokines (e.g., IL-2, IL-12, GM-CSF), cytokine-inducing molecules (e.g., LeIF), costimulatory molecules, or for HTL responses, pan-DR binding proteins (PADRE™, Epimmune, San Diego, Calif.). Helper (HTL) epitopes can be joined to intracellular targeting signals and expressed separately from expressed CTL epitopes; this allows direction of the HTL epitopes to a cell compartment different than that of the CTL epitopes. If required, this could facilitate more efficient entry of HTL epitopes into the HLA class II pathway, thereby improving HTL induction. In contrast to HTL or CTL induction, specifically decreasing the immune response by co-expression of immunosuppressive molecules (e.g. TGF-β) may be beneficial in certain diseases.

Therapeutic quantities of plasmid DNA can be produced for example, by fermentation in E. coli, followed by purification. Aliquots from the working cell bank are used to inoculate growth medium, and grown to saturation in shaker flasks or a bioreactor according to well-known techniques. Plasmid DNA can be purified using standard bioseparation technologies such as solid phase anion-exchange resins supplied by QIAGEN, Inc. (Valencia, Calif.). If required, supercoiled DNA can be isolated from the open circular and linear forms using gel electrophoresis or other methods.

Purified plasmid DNA can be prepared for injection using a variety of formulations. The simplest of these is reconstitution of lyophilized DNA in sterile phosphate-buffer saline (PBS). This approach, known as "naked DNA," is currently being used for intramuscular (IM) administration in clinical trials. To maximize the immunotherapeutic effects of minigene DNA vaccines, an alternative method for formulating purified plasmid DNA may be desirable. A variety of methods have been described, and new techniques may become available. Cationic lipids, glycolipids, and fusogenic liposomes can also be used in the formulation (see, e.g., as described by WO 93/24640; Mannino & Gould-Fogerite, *BioTechniques* 6(7): 682 (1988); U.S. Pat. No. 5,279,833; WO 91/06309; and Felgner, et al., *Proc. Nat'l Acad. Sci. USA* 84:7413 (1987). In addition, peptides and compounds referred to collectively as protective, interactive, non-condensing compounds (PINC) could also be complexed to purified plasmid DNA to influence variables such as stability, intramuscular dispersion, or trafficking to specific organs or cell types.

Target cell sensitization can be used as a functional assay for expression and HLA class I presentation of minigene-encoded CTL epitopes. For example, the plasmid DNA is introduced into a mammalian cell line that is suitable as a target for standard CTL chromium release assays. The transfection method used will be dependent on the final formulation. Electroporation can be used for "naked" DNA, whereas cationic lipids allow direct in vitro transfection. A plasmid expressing green fluorescent protein (GFP) can be co-transfected to allow enrichment of transfected cells using fluorescence activated cell sorting (FACS). These cells are then chromium-51 ($^{51}$Cr) labeled and used as target cells for epitope-specific CTL lines; cytolysis, detected by $^{51}$Cr release, indicates both production of, and HLA presentation of, minigene-encoded CTL epitopes. Expression of HTL epitopes may be evaluated in an analogous manner using assays to assess HTL activity.

In vivo immunogenicity is a second approach for functional testing of minigene DNA formulations. Transgenic mice expressing appropriate human HLA proteins are immunized with the DNA product. The dose and route of administration are formulation dependent (e.g., IM for DNA in PBS, intraperitoneal (i.p.) for lipid-complexed DNA). Twenty-one days after immunization, splenocytes are harvested and restimulated for one week in the presence of peptides encoding each epitope being tested. Thereafter, for CTL effector cells, assays are conducted for cytolysis of peptide-loaded, $^{51}$Cr-labeled target cells using standard techniques. Lysis of target cells that were sensitized by HLA loaded with peptide epitopes, corresponding to minigene-encoded epitopes, demonstrates DNA vaccine function for in vivo induction of CTLs. Immunogenicity of HTL epitopes is confirmed in transgenic mice in an analogous manner.

Alternatively, the nucleic acids can be administered using ballistic delivery as described, for instance, in U.S. Pat. No. 5,204,253. Using this technique, particles comprised solely of DNA are administered. In a further alternative embodiment, DNA can be adhered to particles, such as gold particles.

Minigenes can also be delivered using other bacterial or viral delivery systems well known in the art, e.g., an expression construct encoding epitopes of the invention can be incorporated into a viral vector such as vaccinia.

X.C.2. Combinations of CTL Peptides with Helper Peptides

Vaccine compositions comprising CTL peptides of the invention can be modified, e.g., analoged, to provide desired attributes, such as improved serum half life, broadened population coverage or enhanced immunogenicity.

For instance, the ability of a peptide to induce CTL activity can be enhanced by linking the peptide to a sequence which contains at least one epitope that is capable of inducing a T helper cell response. Although a CTL peptide can be directly linked to a T helper peptide, often CTL epitope/HTL epitope conjugates are linked by a spacer molecule. The spacer is typically comprised of relatively small, neutral molecules, such as amino acids or amino acid mimetics, which are substantially uncharged under physiological conditions. The spacers are typically selected from, e.g., Ala, Gly, or other neutral spacers of nonpolar amino acids or neutral polar amino acids. It will be understood that the optionally present spacer need not be comprised of the same residues and thus may be a hetero- or homo-oligomer. When present, the spacer will usually be at least one or two residues, more usually three to six residues and sometimes 10 or more residues. The CTL peptide epitope can be linked to the T helper peptide epitope either directly or via a spacer either at the amino or carboxy terminus of the CTL peptide. The amino terminus of either the immunogenic peptide or the T helper peptide may be acylated.

In certain embodiments, the T helper peptide is one that is recognized by T helper cells present in a majority of a genetically diverse population. This can be accomplished by selecting peptides that bind to many, most, or all of the HLA class II molecules. Examples of such amino acid bind many HLA Class II molecules include sequences from antigens such as *tetanus toxoid* at positions 830-843 (QYIKANSKFIGITE; SEQ ID NO:1), *Plasmodium falciparum* circumsporozoite (CS) protein at positions 378-398 (DIEKKIAKMEKASSVFNVVNS; SEQ ID NO:2), and *Streptococcus* 18 kD protein at positions 116-131 (GAVDSILGGVATYGAA; SEQ ID NO:3). Other examples include peptides bearing a DR 1-4-7 supermotif, or either of the DR3 motifs.

Alternatively, it is possible to prepare synthetic peptides capable of stimulating T helper lymphocytes, in a loosely HLA-restricted fashion, using amino acid sequences not found in nature (see, e.g., PCT publication WO 95/07707). These synthetic compounds called Pan-DR-binding epitopes (e.g., PADRE™, Epimmune, Inc., San Diego, Calif.) are designed, most preferably, to bind most HLA-DR (human HLA class II) molecules. For instance, a pan-DR-binding epitope peptide having the formula: aKXVAAWTLKAa (SEQ ID NO:4), where "X" is either cyclohexylalanine, phenylalanine, or tyrosine, and a is either D-alanine or L-alanine, has been found to bind to most HLA-DR alleles, and to stimulate the response of T helper lymphocytes from most individuals, regardless of their HLA type. An alternative of a pan-DR binding epitope comprises all "L" natural amino acids and can be provided in the form of nucleic acids that encode the epitope.

HTL peptide epitopes can also be modified to alter their biological properties. For example, they can be modified to include D-amino acids to increase their resistance to proteases and thus extend their serum half life, or they can be conjugated to other molecules such as lipids, proteins, carbohydrates, and the like to increase their biological activity. For example, a T helper peptide can be conjugated to one or more palmitic acid chains at either the amino or carboxyl termini.

X.C.3. Combinations of CTL Peptides with T Cell Priming Agents

In some embodiments it may be desirable to include in the pharmaceutical compositions of the invention at least one component which primes B lymphocytes or T lymphocytes. Lipids have been identified as agents capable of priming CTL in vivo. For example, palmitic acid residues can be attached to the ε- and α-amino groups of a lysine residue and then linked, e.g., via one or more linking residues such as Gly, Gly-Gly-, Ser, Ser-Ser, or the like, to an immunogenic peptide. The lipidated peptide can then be administered either directly in a micelle or particle, incorporated into a liposome, or emulsified in an adjuvant, e.g., incomplete Freund's adjuvant. In a preferred embodiment, a particularly effective immunogenic composition comprises palmitic acid attached to ε- and α-amino groups of Lys, which is attached via linkage, e.g., Ser-Ser, to the amino terminus of the immunogenic peptide.

As another example of lipid priming of CTL responses, *E. coli* lipoproteins, such as tripalmitoyl-S-glycerylcysteinly-seryl-serine ($P_3CSS$) can be used to prime virus specific CTL when covalently attached to an appropriate peptide (see, e.g., Deres, et al., *Nature* 342:561, 1989). Peptides of the invention can be coupled to $P_3CSS$, for example, and the lipopeptide administered to an individual to prime specifically an immune response to the target antigen. Moreover, because the induction of neutralizing antibodies can also be primed with $P_3CSS$-conjugated epitopes, two such compositions can be combined to more effectively elicit both humoral and cell-mediated responses.

X.C.4. Vaccine Compositions Comprising DC Pulsed with CTL and/or HTL Peptides

An embodiment of a vaccine composition in accordance with the invention comprises ex vivo administration of a cocktail of epitope-bearing peptides to PBMC, or isolated DC therefrom, from the patient's blood. A pharmaceutical to facilitate harvesting of DC can be used, such as Progenipoietin™ (Pharmacia-Monsanto, St. Louis, Mo.) or GM-CSF/IL-4. After pulsing the DC with peptides and prior to reinfusion into patients, the DC are washed to remove unbound peptides. In this embodiment, a vaccine comprises peptide-pulsed DCs which present the pulsed peptide epitopes complexed with HLA molecules on their surfaces.

The DC can be pulsed ex vivo with a cocktail of peptides, some of which stimulate CTL responses to PSCA. Optionally, a helper T cell (HTL) peptide, such as a natural or artificial loosely restricted HLA Class II peptide, can be included to facilitate the CTL response. Thus, a vaccine in accordance with the invention is used to treat a cancer which expresses or overexpresses PSCA.

X.D. Adoptive Immunotherapy

Antigenic PSCA-related peptides are used to elicit a CTL and/or HTL response ex vivo, as well. The resulting CTL or HTL cells, can be used to treat tumors in patients that do not respond to other conventional forms of therapy, or will not respond to a therapeutic vaccine peptide or nucleic acid in accordance with the invention. Ex vivo CTL or HTL responses to a particular antigen are induced by incubating in tissue culture the patient's, or genetically compatible, CTL or HTL precursor cells together with a source of antigen-presenting cells (APC), such as dendritic cells, and the appropriate immunogenic peptide. After an appropriate incubation time (typically about 7-28 days), in which the precursor cells are activated and expanded into effector cells, the cells are infused back into the patient, where they will destroy (CTL) or facilitate destruction (HTL) of their specific target cell (e.g., a tumor cell). Transfected dendritic cells may also be used as antigen presenting cells.

X.E. Administration of Vaccines for Therapeutic or Prophylactic Purposes

Pharmaceutical and vaccine compositions of the invention are typically used to treat and/or prevent a cancer that expresses or overexpresses PSCA. In therapeutic applications, peptide and/or nucleic acid compositions are administered to a patient in an amount sufficient to elicit an effective B cell, CTL and/or HTL response to the antigen and to cure or at least partially arrest or slow symptoms and/or complications. An amount adequate to accomplish this is defined as "therapeutically effective dose." Amounts effective for this use will depend on, e.g., the particular composition administered, the manner of administration, the stage and severity of the disease being treated, the weight and general state of health of the patient, and the judgment of the prescribing physician.

For pharmaceutical compositions, the immunogenic peptides of the invention, or DNA encoding them, are generally administered to an individual already bearing a tumor that expresses PSCA. The peptides or DNA encoding them can be administered individually or as fusions of one or more peptide sequences. Patients can be treated with the immunogenic peptides separately or in conjunction with other treatments, such as surgery, as appropriate.

For therapeutic use, administration should generally begin at the first diagnosis of PSCA-associated cancer. This is followed by boosting doses until at least symptoms are substantially abated and for a period thereafter. The embodiment of the vaccine composition (i.e., including, but not limited to embodiments such as peptide cocktails, polyepitopic polypeptides, minigenes, or TAA-specific CTLs or pulsed dendritic cells) delivered to the patient may vary according to the stage of the disease or the patient's health status. For example, in a patient with a tumor that expresses PSCA, a vaccine comprising PSCA-specific CTL may be more efficacious in killing tumor cells in patient with advanced disease than alternative embodiments.

It is generally important to provide an amount of the peptide epitope delivered by a mode of administration sufficient to stimulate effectively a cytotoxic T cell response; compositions which stimulate helper T cell responses can also be given in accordance with this embodiment of the invention.

The dosage for an initial therapeutic immunization generally occurs in a unit dosage range where the lower value is about 1, 5, 50, 500, or 1,000 µg and the higher value is about 10,000; 20,000; 30,000; or 50,000 µg. Dosage values for a human typically range from about 500 µg to about 50,000 µg per 70 kilogram patient. Boosting dosages of between about 1.0 µg to about 50,000 µg of peptide pursuant to a boosting regimen over weeks to months may be administered depending upon the patient's response and condition as determined by measuring the specific activity of CTL and HTL obtained from the patient's blood. Administration should continue until at least clinical symptoms or laboratory tests indicate that the neoplasia, has been eliminated or reduced and for a period thereafter. The dosages, routes of administration, and dose schedules are adjusted in accordance with methodologies known in the art.

In certain embodiments, the peptides and compositions of the present invention are employed in serious disease states, that is, life-threatening or potentially life threatening situations. In such cases, as a result of the minimal amounts of extraneous substances and the relative nontoxic nature of the peptides in preferred compositions of the invention, it is possible and may be felt desirable by the treating physician to administer substantial excesses of these peptide compositions relative to these stated dosage amounts.

The vaccine compositions of the invention can also be used purely as prophylactic agents. Generally the dosage for an initial prophylactic immunization generally occurs in a unit dosage range where the lower value is about 1, 5, 50, 500, or 1000 µg and the higher value is about 10,000; 20,000; 30,000; or 50,000 µg. Dosage values for a human typically range from about 500 µg to about 50,000 µg per 70 kilogram patient. This is followed by boosting dosages of between about 1.0 µg to about 50,000 µg of peptide administered at defined intervals from about four weeks to six months after the initial administration of vaccine. The immunogenicity of the vaccine can be assessed by measuring the specific activity of CTL and HTL obtained from a sample of the patient's blood.

The pharmaceutical compositions for therapeutic treatment are intended for parenteral, topical, oral, nasal, intrathecal, or local (e.g. as a cream or topical ointment) administration. Preferably, the pharmaceutical compositions are administered parentally, e.g., intravenously, subcutaneously, intradermally, or intramuscularly. Thus, the invention provides compositions for parenteral administration which comprise a solution of the immunogenic peptides dissolved or suspended in an acceptable carrier, preferably an aqueous carrier.

A variety of aqueous carriers may be used, e.g., water, buffered water, 0.8% saline, 0.3% glycine, hyaluronic acid and the like. These compositions may be sterilized by conventional, well-known sterilization techniques, or may be sterile filtered. The resulting aqueous solutions may be packaged for use as is, or lyophilized, the lyophilized preparation being combined with a sterile solution prior to administration.

The compositions may contain pharmaceutically acceptable auxiliary substances as required to approximate physiological conditions, such as pH-adjusting and buffering agents, tonicity adjusting agents, wetting agents, preservatives, and the like, for example, sodium acetate, sodium lactate, sodium chloride, potassium chloride, calcium chloride, sorbitan monolaurate, triethanolamine oleate, etc.

The concentration of peptides of the invention in the pharmaceutical formulations can vary widely, i.e., from less than about 0.1%, usually at or at least about 2% to as much as 20% to 50% or more by weight, and will be selected primarily by fluid volumes, viscosities, etc., in accordance with the particular mode of administration selected.

A human unit dose form of a composition is typically included in a pharmaceutical composition that comprises a human unit dose of an acceptable carrier, in one embodiment an aqueous carrier, and is administered in a volume/quantity that is known by those of skill in the art to be used for administration of such compositions to humans (see, e.g., Remington's Pharmaceutical Sciences, $17^{th}$ Edition, A. Gennaro, Editor, Mack Publishing Co., Easton, Pa., 1985). For example a peptide dose for initial immunization can be from about 1 to about 50,000 µg, generally 100-5,000 µg, for a 70 kg patient. For example, for nucleic acids an initial immunization may be performed using an expression vector in the form of naked nucleic acid administered IM (or SC or ID) in the amounts of 0.5-5 mg at multiple sites. The nucleic acid (0.1 to 1000 µg) can also be administered using a gene gun. Following an incubation period of 3-4 weeks, a booster dose is then administered. The booster can be recombinant fowlpox virus administered at a dose of $5\text{-}10^7$ to $5\times10^9$ pfu.

For antibodies, a treatment generally involves repeated administration of the anti-PSCA antibody preparation, via an acceptable route of administration such as intravenous injection (IV), typically at a dose in the range of about 0.1 to about 10 mg/kg body weight. In general, doses in the range of 10-500 mg mAb per week are effective and well tolerated. Moreover, an initial loading dose of approximately 4 mg/kg patient body weight IV, followed by weekly doses of about 2 mg/kg IV of the anti-PSCA mAb preparation represents an acceptable dosing regimen. As appreciated by those of skill in the art, various factors can influence the ideal dose in a particular case. Such factors include, for example, half life of a composition, the binding affinity of an Ab, the immunogenicity of a substance, the degree of PSCA expression in the patient, the extent of circulating shed PSCA antigen, the desired steady-state concentration level, frequency of treatment, and the influence of chemotherapeutic or other agents used in combination with the treatment method of the invention, as well as the health status of a particular patient. Non-limiting preferred human unit doses are, for example, 500 μg-1 mg, 1 mg-50 mg, 50 mg-100 mg, 100 mg-200 mg, 200 mg-300 mg, 400 mg-500 mg, 500 mg-600 mg, 600 mg-700 mg, 700 mg-800 mg, 800 mg-900 mg, 900 mg-1 g, or 1 mg-700 mg. In certain embodiments, the dose is in a range of 2-5 mg/kg body weight, e.g., with follow on weekly doses of 1-3 mg/kg; 0.5 mg, 1, 2, 3, 4, 5, 6, 7, 8, 9, 10 mg/kg body weight followed, e.g., in two, three or four weeks by weekly doses; 0.5-10 mg/kg body weight, e.g., followed in two, three or four weeks by weekly doses; 225, 250, 275, 300, 325, 350, 375, 400 mg m$^2$ of body area weekly; 1-600 mg m$^2$ of body area weekly; 225-400 mg m$^2$ of body area weekly; these does can be followed by weekly doses for 2, 3, 4, 5, 6, 7, 8, 9, 19, 11, 12 or more weeks.

In one embodiment, human unit dose forms of polynucleotides comprise a suitable dosage range or effective amount that provides any therapeutic effect. As appreciated by one of ordinary skill in the art a therapeutic effect depends on a number of factors, including the sequence of the polynucleotide, molecular weight of the polynucleotide and route of administration. Dosages are generally selected by the physician or other health care professional in accordance with a variety of parameters known in the art, such as severity of symptoms, history of the patient and the like. Generally, for a polynucleotide of about 20 bases, a dosage range may be selected from, for example, an independently selected lower limit such as about 0.1, 0.25, 0.5, 1, 2, 5, 10, 20, 30, 40, 50, 60, 70, 80, 90, 100, 200, 300, 400 or 500 mg/kg up to an independently selected upper limit, greater than the lower limit, of about 60, 80, 100, 200, 300, 400, 500, 750, 1000, 1500, 2000, 3000, 4000, 5000, 6000, 7000, 8000, 9000 or 10,000 mg/kg. For example, a dose may be about any of the following: 0.1 to 100 mg/kg, 0.1 to 50 mg/kg, 0.1 to 25 mg/kg, 0.1 to 10 mg/kg, 1 to 500 mg/kg, 100 to 400 mg/kg, 200 to 300 mg/kg, 1 to 100 mg/kg, 100 to 200 mg/kg, 300 to 400 mg/kg, 400 to 500 mg/kg, 500 to 1000 mg/kg, 500 to 5000 mg/kg, or 500 to 10,000 mg/kg. Generally, parenteral routes of administration may require higher doses of polynucleotide compared to more direct application to the nucleotide to diseased tissue, as do polynucleotides of increasing length.

In one embodiment, human unit dose forms of T-cells comprise a suitable dosage range or effective amount that provides any therapeutic effect. As appreciated by one of ordinary skill in the art, a therapeutic effect depends on a number of factors. Dosages are generally selected by the physician or other health care professional in accordance with a variety of parameters known in the art, such as severity of symptoms, history of the patient and the like. A dose may be about $10^4$ cells to about $10^6$ cells, about $10^6$ cells to about $10^8$ cells, about $10^8$ to about $10^{11}$ cells, or about $10^8$ to about $5 \times 10^{10}$ cells. A dose may also about $10^6$ cells/m$^2$ to about $10^{10}$ cells/m$^2$, or about $10^6$ cells/m$^2$ to about $10^8$ cells/m$^2$.

Proteins(s) of the invention, and/or nucleic acids encoding the protein(s), can also be administered via liposomes, which may also serve to: 1) target the proteins(s) to a particular tissue, such as lymphoid tissue; 2) to target selectively to diseases cells; or, 3) to increase the half-life of the peptide composition. Liposomes include emulsions, foams, micelles, insoluble monolayers, liquid crystals, phospholipid dispersions, lamellar layers and the like. In these preparations, the peptide to be delivered is incorporated as part of a liposome, alone or in conjunction with a molecule which binds to a receptor prevalent among lymphoid cells, such as monoclonal antibodies which bind to the CD45 antigen, or with other therapeutic or immunogenic compositions. Thus, liposomes either filled or decorated with a desired peptide of the invention can be directed to the site of lymphoid cells, where the liposomes then deliver the peptide compositions. Liposomes for use in accordance with the invention are formed from standard vesicle-forming lipids, which generally include neutral and negatively charged phospholipids and a sterol, such as cholesterol. The selection of lipids is generally guided by consideration of, e.g., liposome size, acid lability and stability of the liposomes in the blood stream. A variety of methods are available for preparing liposomes, as described in, e.g., Szoka, et al., *Ann. Rev. Biophys. Bioeng.* 9:467 (1980), and U.S. Pat. Nos. 4,235,871, 4,501,728, 4,837,028, and 5,019,369.

For targeting cells of the immune system, a ligand to be incorporated into the liposome can include, e.g., antibodies or fragments thereof specific for cell surface determinants of the desired immune system cells. A liposome suspension containing a peptide may be administered intravenously, locally, topically, etc. in a dose which varies according to, inter alia, the manner of administration, the peptide being delivered, and the stage of the disease being treated.

For solid compositions, conventional nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10-95% of active ingredient, that is, one or more peptides of the invention, and more preferably at a concentration of 25%-75%.

For aerosol administration, immunogenic peptides are preferably supplied in finely divided form along with a surfactant and propellant. Typical percentages of peptides are about 0.01%-20% by weight, preferably about 1%-10%. The surfactant must, of course, be nontoxic, and preferably soluble in the propellant. Representative of such agents are the esters or partial esters of fatty acids containing from about 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute about 0.1%-20% by weight of the composition, preferably about 0.25-5%. The balance of the composition is ordinarily propellant. A carrier can also be included, as desired, as with, e.g., lecithin for intranasal delivery.

XI.) Diagnostic and Prognostic Embodiments of PSCA.

As disclosed herein, PSCA polynucleotides, polypeptides, reactive cytotoxic T cells (CTL), reactive helper T cells (HTL) and anti-polypeptide antibodies are used in well known diagnostic, prognostic and therapeutic assays that examine conditions associated with dysregulated cell growth such as cancer, in particular the cancers listed in Table I (see, e.g., both its specific pattern of tissue expression as well as its overexpression in certain cancers as described for example in the Example entitled "Expression analysis of PSCA in normal tissues, and patient specimens").

PSCA can be analogized to a prostate associated antigen PSA, the archetypal marker that has been used by medical practitioners for years to identify and monitor the presence of prostate cancer (see, e.g., Merrill et al., J. Urol. 163(2): 503-5120 (2000); Polascik et al., J. Urol. August; 162(2):293-306 (1999) and Fortier et al., J. Nat. Cancer Inst. 91(19): 1635-1640(1999)). A variety of other diagnostic markers are also used in similar contexts including p53 and K-ras (see, e.g., Tulchinsky et al., Int J Mol Med 1999 Jul. 4(1):99-102 and Minimoto et al., Cancer Detect Prev 2000;24(1):1-12). Therefore, this disclosure of PSCA polynucleotides and polypeptides (as well as PSCA polynucleotide probes and anti-PSCA antibodies used to identify the presence of these molecules) and their properties allows skilled artisans to utilize these molecules in methods that are analogous to those used, for example, in a variety of diagnostic assays directed to examining conditions associated with cancer.

Typical embodiments of diagnostic methods which utilize the PSCA polynucleotides, polypeptides, reactive T cells and antibodies are analogous to those methods from well-established diagnostic assays, which employ, e.g., PSA polynucleotides, polypeptides, reactive T cells and antibodies. For example, just as PSA polynucleotides are used as probes (for example in Northern analysis, see, e.g., Sharief et al., Biochem. Mol. Biol. Int. 33(3):567-74(1994)) and primers (for example in PCR analysis, see, e.g., Okegawa et al., J. Urol. 163(4): 1189-1190 (2000)) to observe the presence and/or the level of PSA mRNAs in methods of monitoring PSA overexpression or the metastasis of prostate cancers, the PSCA polynucleotides described herein can be utilized in the same way to detect PSCA overexpression or the metastasis of prostate and other cancers expressing this gene. Alternatively, just as PSA polypeptides are used to generate antibodies specific for PSA which can then be used to observe the presence and/or the level of PSA proteins in methods to monitor PSA protein overexpression (see, e.g., Stephan et al., Urology 55(4):560-3 (2000)) or the metastasis of prostate cells (see, e.g., Alanen et al., Pathol. Res. Pract. 192(3):233-7 (1996)), the PSCA polypeptides described herein can be utilized to generate antibodies for use in detecting PSCA overexpression or the metastasis of prostate cells and cells of other cancers expressing this gene.

Specifically, because metastases involves the movement of cancer cells from an organ of origin (such as the lung or prostate gland etc.) to a different area of the body (such as a lymph node), assays which examine a biological sample for the presence of cells expressing PSCA polynucleotides and/or polypeptides can be used to provide evidence of metastasis. For example, when a biological sample from tissue that does not normally contain PSCA-expressing cells (lymph node) is found to contain PSCA-expressing cells such as the PSCA expression seen in LAPC4 and LAPC9, xenografts isolated from lymph node and bone metastasis, respectively, this finding is indicative of metastasis.

Alternatively PSCA polynucleotides and/or polypeptides can be used to provide evidence of cancer, for example, when cells in a biological sample that do not normally express PSCA or express PSCA at a different level are found to express PSCA or have an increased expression of PSCA (see, e.g., the PSCA expression in the cancers listed in Table I and in patient samples etc. shown in the accompanying Figures). In such assays, artisans may further wish to generate supplementary evidence of metastasis by testing the biological sample for the presence of a second tissue restricted marker (in addition to PSCA) such as PSA, PSCA etc. (see, e.g., Alanen et al., Pathol. Res. Pract. 192(3): 233-237 (1996)).

The use of immunohistochemistry to identify the presence of a PSCA polypeptide within a tissue section can indicate an altered state of certain cells within that tissue. It is well understood in the art that the ability of an antibody to localize to a polypeptide that is expressed in cancer cells is a way of diagnosing presence of disease, disease stage, progression and/or tumor aggressiveness. Such an antibody can also detect an altered distribution of the polypeptide within the cancer cells, as compared to corresponding non-malignant tissue.

The PSCA polypeptide and immunogenic compositions are also useful in view of the phenomena of altered subcellular protein localization in disease states. Alteration of cells from normal to diseased state causes changes in cellular morphology and is often associated with changes in subcellular protein localization/distribution. For example, cell membrane proteins that are expressed in a polarized manner in normal cells can be altered in disease, resulting in distribution of the protein in a non-polar manner over the whole cell surface.

The phenomenon of altered subcellular protein localization in a disease state has been demonstrated with MUC1 and Her2 protein expression by use of immunohistochemical means. Normal epithelial cells have a typical apical distribution of MUC1, in addition to some supranuclear localization of the glycoprotein, whereas malignant lesions often demonstrate an apolar staining pattern (Diaz et al, The Breast Journal, 7; 40-45 (2001); Zhang et al, Clinical Cancer Research, 4; 2669-2676 (1998): Cao, et al, The Journal of Histochemistry and Cytochemistry, 45: 1547-1557 (1997)). In addition, normal breast epithelium is either negative for Her2 protein or exhibits only a basolateral distribution whereas malignant cells can express the protein over the whole cell surface (De Potter, et al, International Journal of Cancer, 44; 969-974 (1989): McCormick, et al, 117; 935-943 (2002)). Alternatively, distribution of the protein may be altered from a surface only localization to include diffuse cytoplasmic expression in the diseased state. Such an example can be seen with MUC1 (Diaz, et al, The Breast Journal, 7: 40-45 (2001)).

Alteration in the localization/distribution of a protein in the cell, as detected by immunohistochemical methods, can also provide valuable information concerning the favorability of certain treatment modalities. This last point is illustrated by a situation where a protein may be intracellular in normal tissue, but cell surface in malignant cells; the cell surface location makes the cells favorably amenable to antibody-based diagnostic and treatment regimens. When such an alteration of protein localization occurs for PSCA, the PSCA protein and immune responses related thereto are very useful. Accordingly, the ability to determine whether alteration of subcellular protein localization occurred for 24P4C12 make the PSCA protein and immune responses related thereto very useful. Use of the PSCA compositions allows those skilled in the art to make important diagnostic and therapeutic decisions.

Immunohistochemical reagents specific to PSCA are also useful to detect metastases of tumors expressing PSCA when the polypeptide appears in tissues where PSCA is not normally produced.

Thus, PSCA polypeptides and antibodies resulting from immune responses thereto are useful in a variety of important contexts such as diagnostic, prognostic, preventative and/or therapeutic purposes known to those skilled in the art.

Just as PSA polynucleotide fragments and polynucleotide variants are employed by skilled artisans for use in methods of monitoring PSA, PSCA polynucleotide fragments and polynucleotide variants are used in an analogous manner. In particular, typical PSA polynucleotides used in methods of monitoring PSA are probes or primers which consist of fragments of the PSA cDNA sequence. Illustrating this, primers used to PCR amplify a PSA polynucleotide must include less than the whole PSA sequence to function in the polymerase chain reaction. In the context of such PCR reactions, skilled artisans generally create a variety of different polynucleotide fragments that can be used as primers in order to amplify different portions of a polynucleotide of interest or to optimize amplification reactions (see, e.g., Caetano-Anolles, G. Biotechniques 25(3): 472-476, 478-480 (1998); Robertson et al., Methods Mol. Biol. 98:121-154 (1998)). An additional illustration of the use of such fragments is provided in the Example entitled "Expression analysis of PSCA in normal tissues, and patient specimens," where a PSCA polynucleotide fragment is used as a probe to show the expression of PSCA RNAs in cancer cells. In addition, variant polynucleotide sequences are typically used as primers and probes for the corresponding mRNAs in PCR and Northern analyses (see, e.g., Sawai et al., Fetal Diagn. Ther. 1996 November-December 11(6):407-13 and Current Protocols In Molecular Biology, Volume 2, Unit 2, Frederick M. Ausubel et al. eds., 1995)). Polynucleotide fragments and variants are useful in this context where they are capable of binding to a target polynucleotide sequence (e.g., a PSCA polynucleotide shown in FIG. 2 or variant thereof) under conditions of high stringency.

Furthermore, PSA polypeptides which contain an epitope that can be recognized by an antibody or T cell that specifically binds to that epitope are used in methods of monitoring PSA. PSCA polypeptide fragments and polypeptide analogs or variants can also be used in an analogous manner. This practice of using polypeptide fragments or polypeptide variants to generate antibodies (such as anti-PSA antibodies or T cells) is typical in the art with a wide variety of systems such as fusion proteins being used by practitioners (see, e.g., Current Protocols In Molecular Biology, Volume 2, Unit 16, Frederick M. Ausubel et al. eds., 1995). In this context, each epitope(s) functions to provide the architecture with which an antibody or T cell is reactive. Typically, skilled artisans create a variety of different polypeptide fragments that can be used in order to generate immune responses specific for different portions of a polypeptide of interest (see, e.g., U.S. Pat. No. 5,840,501 and U.S. Pat. No. 5,939,533). For example it may be preferable to utilize a polypeptide comprising one of the PSCA biological motifs discussed herein or a motif-bearing subsequence which is readily identified by one of skill in the art based on motifs available in the art. Polypeptide fragments, variants or analogs are typically useful in this context as long as they comprise an epitope capable of generating an antibody or T cell specific for a target polypeptide sequence (e.g. a PSCA polypeptide shown in FIG. 3).

As shown herein, the PSCA polynucleotides and polypeptides (as well as the PSCA polynucleotide probes and anti-PSCA antibodies or T cells used to identify the presence of these molecules) exhibit specific properties that make them useful in diagnosing cancers such as those listed in Table I. Diagnostic assays that measure the presence of PSCA gene products, in order to evaluate the presence or onset of a disease condition described herein, such as prostate cancer, are used to identify patients for preventive measures or further monitoring, as has been done so successfully with PSA. Moreover, these materials satisfy a need in the art for molecules having similar or complementary characteristics to PSA in situations where, for example, a definite diagnosis of metastasis of prostatic origin cannot be made on the basis of a test for PSA alone (see, e.g., Alanen et al., Pathol. Res. Pract. 192(3): 233-237 (1996)), and consequently, materials such as PSCA polynucleotides and polypeptides (as well as the PSCA polynucleotide probes and anti-PSCA antibodies used to identify the presence of these molecules) need to be employed to confirm a metastases of prostatic origin.

Finally, in addition to their use in diagnostic assays, the PSCA polynucleotides disclosed herein have a number of other utilities such as their use in the identification of oncogenetic associated chromosomal abnormalities in the chromosomal region to which the PSCA gene maps (see the Example entitled "Chromosomal Mapping of PSCA" below). Moreover, in addition to their use in diagnostic assays, the PSCA-related proteins and polynucleotides disclosed herein have other utilities such as their use in the forensic analysis of tissues of unknown origin (see, e.g., Takahama K Forensic Sci Int 1996 Jun. 28;80(1-2): 63-9).

Additionally, PSCA-related proteins or polynucleotides of the invention can be used to treat a pathologic condition characterized by the over-expression of PSCA. For example, the amino acid or nucleic acid sequence of FIG. 2 or FIG. 3, or fragments of either, can be used to generate an immune response to a PSCA antigen. Antibodies or other molecules that react with PSCA can be used to modulate the function of this molecule, and thereby provide a therapeutic benefit.

XII.) Inhibition of PSCA Protein Function

The invention includes various methods and compositions for inhibiting the binding of PSCA to its binding partner or its association with other protein(s) as well as methods for inhibiting PSCA function.

XII.A.) Inhibition of PSCA With Intracellular Antibodies

In one approach, a recombinant vector that encodes single chain antibodies that specifically bind to PSCA are introduced into PSCA expressing cells via gene transfer technologies. Accordingly, the encoded single chain anti-PSCA antibody is expressed intracellularly, binds to PSCA protein, and thereby inhibits its function. Methods for engineering such intracellular single chain antibodies are well known. Such intracellular antibodies, also known as "intrabodies", are specifically targeted to a particular compartment within the cell, providing control over where the inhibitory activity of the treatment is focused. This technology has been successfully applied in the art (for review, see Richardson and Marasco, 1995, TIBTECH vol. 13). Intrabodies have been shown to virtually eliminate the expression of otherwise abundant cell surface receptors (see, e.g., Richardson et al., 1995, Proc. Natl. Acad. Sci. USA 92: 3137-3141; Beerli et al., 1994, J. Biol. Chem. 289: 23931-23936; Deshane et al., 1994, Gene Ther. 1: 332-337).

Single chain antibodies comprise the variable domains of the heavy and light chain joined by a flexible linker polypeptide, and are expressed as a single polypeptide. Optionally, single chain antibodies are expressed as a single chain variable region fragment joined to the light chain constant region. Well-known intracellular trafficking signals are engineered into recombinant polynucleotide vectors encoding such single chain antibodies in order to target precisely the intrabody to the desired intracellular compartment. For example, intrabodies targeted to the endoplasmic reticulum (ER) are engineered to incorporate a leader peptide and, optionally, a C-terminal ER retention signal, such as the KDEL amino acid motif. Intrabodies intended to exert activity in the nucleus are engineered to include a nuclear localization signal. Lipid moieties are joined to intrabodies in order to tether the intrabody to the cytosolic side of the plasma membrane. Intrabodies can also be targeted to exert function in the cytosol. For example, cytosolic intrabodies are used to sequester factors within the cytosol, thereby preventing them from being transported to their natural cellular destination.

In one embodiment, intrabodies are used to capture PSCA in the nucleus, thereby preventing its activity within the nucleus. Nuclear targeting signals are engineered into such PSCA intrabodies in order to achieve the desired targeting. Such PSCA intrabodies are designed to bind specifically to a particular PSCA domain. In another embodiment, cytosolic intrabodies that specifically bind to a PSCA protein are used to prevent PSCA from gaining access to the nucleus, thereby preventing it from exerting any biological activity within the nucleus (e.g., preventing PSCA from forming transcription complexes with other factors).

In order to specifically direct the expression of such intrabodies to particular cells, the transcription of the intrabody is placed under the regulatory control of an appropriate tumor-specific promoter and/or enhancer. In order to target intrabody expression specifically to prostate, for example, the PSA promoter and/or promoter/enhancer can be utilized (See, for example, U.S. Pat. No. 5,919,652 issued 6 Jul. 1999).

XII.B.) Inhibition of PSCA with Recombinant Proteins

In another approach, recombinant molecules bind to PSCA and thereby inhibit PSCA function. For example, these recombinant molecules prevent or inhibit PSCA from accessing/binding to its binding partner(s) or associating with other protein(s). Such recombinant molecules can, for example, contain the reactive part(s) of a PSCA specific antibody molecule. In a particular embodiment, the PSCA binding domain of a PSCA binding partner is engineered into a dimeric fusion protein, whereby the fusion protein comprises two PSCA ligand binding domains linked to the Fc portion of a human IgG, such as human IgG1. Such IgG portion can contain, for example, the $C_H2$ and $C_H3$ domains and the hinge region, but not the $C_H1$ domain. Such dimeric fusion proteins are administered in soluble form to patients suffering from a cancer associated with the expression of PSCA, whereby the dimeric fusion protein specifically binds to PSCA and blocks PSCA interaction with a binding partner. Such dimeric fusion proteins are further combined into multimeric proteins using known antibody linking technologies.

XII.C.) Inhibition of PSCA Transcription or Translation

The present invention also comprises various methods and compositions for inhibiting the transcription of the PSCA gene. Similarly, the invention also provides methods and compositions for inhibiting the translation of PSCA mRNA into protein.

In one approach, a method of inhibiting the transcription of the PSCA gene comprises contacting the PSCA gene with a PSCA antisense polynucleotide. In another approach, a method of inhibiting PSCA mRNA translation comprises contacting a PSCA mRNA with an antisense polynucleotide. In another approach, a PSCA specific ribozyme is used to cleave a PSCA message, thereby inhibiting translation. Such antisense and ribozyme based methods can also be directed to the regulatory regions of the PSCA gene, such as PSCA promoter and/or enhancer elements. Similarly, proteins capable of inhibiting a PSCA gene transcription factor are used to inhibit PSCA mRNA transcription. The various polynucleotides and compositions useful in the aforementioned methods have been described above. The use of antisense and ribozyme molecules to inhibit transcription and translation is well known in the art.

Other factors that inhibit the transcription of PSCA by interfering with PSCA transcriptional activation are also useful to treat cancers expressing PSCA. Similarly, factors that interfere with PSCA processing are useful to treat cancers that express PSCA. Cancer treatment methods utilizing such factors are also within the scope of the invention.

XII.D.) General Considerations for Therapeutic Strategies

Gene transfer and gene therapy technologies can be used to deliver therapeutic polynucleotide molecules to tumor cells synthesizing PSCA (i.e., antisense, ribozyme, polynucleotides encoding intrabodies and other PSCA inhibitory molecules). A number of gene therapy approaches are known in the art. Recombinant vectors encoding PSCA antisense polynucleotides, ribozymes, factors capable of interfering with PSCA transcription, and so forth, can be delivered to target tumor cells using such gene therapy approaches.

The above therapeutic approaches can be combined with any one of a wide variety of surgical, chemotherapy or radiation therapy regimens. The therapeutic approaches of the invention can enable the use of reduced dosages of chemotherapy (or other therapies) and/or less frequent administration, an advantage for all patients and particularly for those that do not tolerate the toxicity of the chemotherapeutic agent well.

The anti-tumor activity of a particular composition (e.g., antisense, ribozyme, intrabody), or a combination of such compositions, can be evaluated using various in vitro and in vivo assay systems. In vitro assays that evaluate therapeutic activity include cell growth assays, soft agar assays and other assays indicative of tumor promoting activity, binding assays capable of determining the extent to which a therapeutic composition will inhibit the binding of PSCA to a binding partner, etc.

In vivo, the effect of a PSCA therapeutic composition can be evaluated in a suitable animal model. For example, xenogenic prostate cancer models can be used, wherein human prostate cancer explants or passaged xenograft tissues are introduced into immune compromised animals, such as nude or SCID mice (Klein et al., 1997, Nature Medicine 3: 402-408). For example, PCT Patent Application W098/16628 and U.S. Pat. No. 6,107,540 describe various xenograft models of human prostate cancer capable of recapitulating the development of primary tumors, micrometastasis, and the formation of osteoblastic metastases characteristic of late stage disease. Efficacy can be predicted using assays that measure inhibition of tumor formation, tumor regression or metastasis, and the like.

In vivo assays that evaluate the promotion of apoptosis are useful in evaluating therapeutic compositions. In one embodiment, xenografts from tumor bearing mice treated with the therapeutic composition can be examined for the presence of apoptotic foci and compared to untreated control xenograft-bearing mice. The extent to which apoptotic foci are found in the tumors of the treated mice provides an indication of the therapeutic efficacy of the composition.

The therapeutic compositions used in the practice of the foregoing methods can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, Remington's Pharmaceutical Sciences 16$^{th}$ Edition, A. Osal., Ed., 1980).

Therapeutic formulations can be solubilized and administered via any route capable of delivering the therapeutic composition to the tumor site. Potentially effective routes of administration include, but are not limited to, intravenous, parenteral, intraperitoneal, intramuscular, intratumor, intradermal, intraorgan, orthotopic, and the like. A preferred formulation for intravenous injection comprises the therapeutic composition in a solution of preserved bacteriostatic water, sterile unpreserved water, and/or diluted in polyvinylchloride or polyethylene bags containing 0.9% sterile Sodium Chloride for Injection, USP. Therapeutic protein preparations can be lyophilized and stored as sterile powders, preferably under vacuum, and then reconstituted in bacteriostatic water (containing for example, benzyl alcohol preservative) or in sterile water prior to injection.

Dosages and administration protocols for the treatment of cancers using the foregoing methods will vary with the method and the target cancer, and will generally depend on a number of other factors appreciated in the art.

XIII.) Identification, Characterization and Use of Modulators of PSCA

Methods to Identify and Use Modulators

In one embodiment, screening is performed to identify modulators that induce or suppress a particular expression profile, suppress or induce specific pathways, preferably generating the associated phenotype thereby. In another embodiment, having identified differentially expressed genes important in a particular state; screens are performed to identify modulators that alter expression of individual genes, either increase or decrease. In another embodiment, screening is performed to identify modulators that alter a biological function of the expression product of a differentially expressed gene. Again, having identified the importance of a gene in a particular state, screens are performed to identify agents that bind and/or modulate the biological activity of the gene product.

In addition, screens are done for genes that are induced in response to a candidate agent. After identifying a modulator (one that suppresses a cancer expression pattern leading to a normal expression pattern, or a modulator of a cancer gene that leads to expression of the gene as in normal tissue) a screen is performed to identify genes that are specifically modulated in response to the agent. Comparing expression profiles between normal tissue and agent-treated cancer tissue reveals genes that are not expressed in normal tissue or cancer tissue, but are expressed in agent treated tissue, and vice versa. These agent-specific sequences are identified and used by methods described herein for cancer genes or proteins. In particular these sequences and the proteins they encode are used in marking or identifying agent-treated cells. In addition, antibodies are raised against the agent-induced proteins and used to target novel therapeutics to the treated cancer tissue sample.

Modulator-related Identification and Screening Assays:
Gene Expression-related Assays Proteins, nucleic acids, and antibodies of the invention are used in screening assays. The cancer-associated proteins, antibodies, nucleic acids, modified proteins and cells containing these sequences are used in screening assays, such as evaluating the effect of drug candidates on a "gene expression profile," expression profile of polypeptides or alteration of biological function. In one embodiment, the expression profiles are used, preferably in conjunction with high throughput screening techniques to allow monitoring for expression profile genes after treatment with a candidate agent (e.g., Davis, G F, et al, J Biol Screen 7:69 (2002); Zlokarnik, et al., Science 279:84-8 (1998); Heid, Genome Res 6:986-94,1996).

The cancer proteins, antibodies, nucleic acids, modified proteins and cells containing the native or modified cancer proteins or genes are used in screening assays. That is, the present invention comprises methods for screening for compositions which modulate the cancer phenotype or a physiological function of a cancer protein of the invention. This is done on a gene itself or by evaluating the effect of drug candidates on a "gene expression profile" or biological function. In one embodiment, expression profiles are used, preferably in conjunction with high throughput screening techniques to allow monitoring after treatment with a candidate agent, see Zlokamik, supra.

A variety of assays are executed directed to the genes and proteins of the invention. Assays are run on an individual nucleic acid or protein level. That is, having identified a particular gene as up regulated in cancer, test compounds are screened for the ability to modulate gene expression or for binding to the cancer protein of the invention. "Modulation" in this context includes an increase or a decrease in gene expression. The preferred amount of modulation will depend on the original change of the gene expression in normal versus tissue undergoing cancer, with changes of at least 10%, preferably 50%, more preferably 100-300%, and in some embodiments 300-1000% or greater. Thus, if a gene exhibits a 4-fold increase in cancer tissue compared to normal tissue, a decrease of about four-fold is often desired; similarly, a 10-fold decrease in cancer tissue compared to normal tissue a target value of a 10-fold increase in expression by the test compound is often desired. Modulators that exacerbate the type of gene expression seen in cancer are also useful, e.g., as an upregulated target in further analyses.

The amount of gene expression is monitored using nucleic acid probes and the quantification of gene expression levels, or, alternatively, a gene product itself is monitored, e.g., through the use of antibodies to the cancer protein and standard immunoassays. Proteomics and separation techniques also allow for quantification of expression.

Expression Monitoring to Identify Compounds that Modify Gene Expression

In one embodiment, gene expression monitoring, i.e., an expression profile, is monitored simultaneously for a number of entities. Such profiles will typically involve one or more of the genes of FIG. 2. In this embodiment, e.g., cancer nucleic acid probes are attached to biochips to detect and quantify cancer sequences in a particular cell. Alternatively, PCR can be used. Thus, a series, e.g., wells of a microtiter plate, can be used with dispensed primers in desired wells. A PCR reaction can then be performed and analyzed for each well.

Expression monitoring is performed to identify compounds that modify the expression of one or more cancer-associated sequences, e.g., a polynucleotide sequence set out in FIG. 2. Generally, a test modulator is added to the cells prior to analysis. Moreover, screens are also provided to identify agents that modulate cancer, modulate cancer proteins of the invention, bind to a cancer protein of the invention, or interfere with the binding of a cancer protein of the invention and an antibody or other binding partner.

In one embodiment, high throughput screening methods involve providing a library containing a large number of potential therapeutic compounds (candidate compounds). Such "combinatorial chemical libraries" are then screened in one or more assays to identify those library members (particular chemical species or subclasses) that display a desired characteristic activity. The compounds thus identified can serve as conventional "lead compounds," as compounds for screening, or as therapeutics.

In certain embodiments, combinatorial libraries of potential modulators are screened for an ability to bind to a cancer polypeptide or to modulate activity. Conventionally, new chemical entities with useful properties are generated by identifying a chemical compound (called a "lead compound") with some desirable property or activity, e.g., inhibiting activity, creating variants of the lead compound, and evaluating the property and activity of those variant compounds. Often, high throughput screening (HTS) methods are employed for such an analysis.

As noted above, gene expression monitoring is conveniently used to test candidate modulators (e.g., protein, nucleic acid or small molecule). After the candidate agent has been added and the cells allowed to incubate for a period, the sample containing a target sequence to be analyzed is, e.g., added to a biochip.

If required, the target sequence is prepared using known techniques. For example, a sample is treated to lyse the cells, using known lysis buffers, electroporation, etc., with purification and/or amplification such as PCR performed as appropriate. For example, an in vitro transcription with labels covalently attached to the nucleotides is performed. Generally, the nucleic acids are labeled with biotin-FITC or PE, or with cy3 or cy5.

The target sequence can be labeled with, e.g., a fluorescent, a chemiluminescent, a chemical, or a radioactive signal, to provide a means of detecting the target sequence's specific binding to a probe. The label also can be an enzyme, such as alkaline phosphatase or horseradish peroxidase, which when provided with an appropriate substrate produces a product that is detected. Alternatively, the label is a labeled compound or small molecule, such as an enzyme inhibitor, that binds but is not catalyzed or altered by the enzyme. The label also can be a moiety or compound, such as, an epitope tag or biotin which specifically binds to streptavidin. For the example of biotin, the streptavidin is labeled as described above, thereby, providing a detectable signal for the bound target sequence. Unbound labeled streptavidin is typically removed prior to analysis.

As will be appreciated by those in the art, these assays can be direct hybridization assays or can comprise "sandwich assays", which include the use of multiple probes, as is generally outlined in U.S. Pat. Nos. 5,681,702; 5,597,909; 5,545,730; 5,594,117; 5,591,584; 5,571,670; 5,580,731; 5,571,670; 5,591,584; 5,624,802; 5,635,352; 5,594,118; 5,359,100; 5,124,246; and 5,681,697. In this embodiment, in general, the target nucleic acid is prepared as outlined above, and then added to the biochip comprising a plurality of nucleic acid probes, under conditions that allow the formation of a hybridization complex.

A variety of hybridization conditions are used in the present invention, including high, moderate and low stringency conditions as outlined above. The assays are generally run under stringency conditions which allow formation of the label probe hybridization complex only in the presence of target. Stringency can be controlled by altering a step parameter that is a thermodynamic variable, including, but not limited to, temperature, formamide concentration, salt concentration, chaotropic salt concentration pH, organic solvent concentration, etc. These parameters may also be used to control non-specific binding, as is generally outlined in U.S. Pat. No. 5,681,697. Thus, it can be desirable to perform certain steps at higher stringency conditions to reduce non-specific binding.

The reactions outlined herein can be accomplished in a variety of ways. Components of the reaction can be added simultaneously, or sequentially, in different orders, with preferred embodiments outlined below. In addition, the reaction may include a variety of other reagents. These include salts, buffers, neutral proteins, e.g. albumin, detergents, etc. which can be used to facilitate optimal hybridization and detection, and/or reduce nonspecific or background interactions. Reagents that otherwise improve the efficiency of the assay, such as protease inhibitors, nuclease inhibitors, anti-microbial agents, etc., may also be used as appropriate, depending on the sample preparation methods and purity of the target. The assay data are analyzed to determine the expression levels of individual genes, and changes in expression levels as between states, forming a gene expression profile.

Biological Activity-related Assays

The invention provides methods identify or screen for a compound that modulates the activity of a cancer-related gene or protein of the invention. The methods comprise adding a test compound, as defined above, to a cell comprising a cancer protein of the invention. The cells contain a recombinant nucleic acid that encodes a cancer protein of the invention. In another embodiment, a library of candidate agents is tested on a plurality of cells.

In one aspect, the assays are evaluated in the presence or absence or previous or subsequent exposure of physiological signals, e.g. hormones, antibodies, peptides, antigens, cytokines, growth factors, action potentials, pharmacological agents including chemotherapeutics, radiation, carcinogenics, or other cells (i.e., cell-cell contacts). In another example, the determinations are made at different stages of the cell cycle process. In this way, compounds that modulate genes or proteins of the invention are identified. Compounds with pharmacological activity are able to enhance or interfere with the activity of the cancer protein of the invention. Once identified, similar structures are evaluated to identify critical structural features of the compound.

In one embodiment, a method of modulating (e.g., inhibiting) cancer cell division is provided; the method comprises administration of a cancer modulator. In another embodiment, a method of modulating (e.g., inhibiting) cancer is provided; the method comprises administration of a cancer modulator. In a further embodiment, methods of treating cells or individuals with cancer are provided; the method comprises administration of a cancer modulator.

In one embodiment, a method for modulating the status of a cell that expresses a gene of the invention is provided. As used herein status comprises such art-accepted parameters such as growth, proliferation, survival, function, apoptosis, senescence, location, enzymatic activity, signal transduction, etc. of a cell. In one embodiment, a cancer inhibitor is an antibody as discussed above. In another embodiment, the cancer inhibitor is an antisense molecule. A variety of cell growth, proliferation, and metastasis assays are known to those of skill in the art, as described herein.

High Throughput Screening to Identify Modulators

The assays to identify suitable modulators are amenable to high throughput screening. Preferred assays thus detect enhancement or inhibition of cancer gene transcription, inhibition or enhancement of polypeptide expression, and inhibition or enhancement of polypeptide activity.

In one embodiment, modulators evaluated in high throughput screening methods are proteins, often naturally occurring proteins or fragments of naturally occurring proteins. Thus, e.g., cellular extracts containing proteins, or random or directed digests of proteinaceous cellular extracts, are used. In this way, libraries of proteins are made for screening in the methods of the invention. Particularly preferred in this embodiment are libraries of bacterial, fungal, viral, and mammalian proteins, with the latter being preferred, and human proteins being especially preferred. Particularly useful test compound will be directed to the class of proteins to which the target belongs, e.g., substrates for enzymes, or ligands and receptors.

Use of Soft Agar Growth and Colony Formation to Identify and Characterize Modulators Normal cells require a solid substrate to attach and grow. When cells are transformed, they lose this phenotype and grow detached from the substrate. For example, transformed cells can grow in stirred suspension culture or suspended in semi-solid media, such as semi-solid or soft agar. The transformed cells, when transfected with tumor suppressor genes, can regenerate normal phenotype and once again require a solid substrate to attach to and grow. Soft agar growth or colony formation in assays are used to identify modulators of cancer sequences, which when expressed in host cells, inhibit abnormal cellular proliferation and transformation. A modulator reduces or eliminates the host cells' ability to grow suspended in solid or semisolid media, such as agar.

Techniques for soft agar growth or colony formation in suspension assays are described in Freshney, Culture of Animal Cells a Manual of Basic Technique (3rd ed., 1994). See also, the methods section of Garkavtsev et al. (1996), supra.

Evaluation of Contact Inhibition and Growth Density Limitation to Identify and Characterize Modulators Normal cells typically grow in a flat and organized pattern in cell culture until they touch other cells. When the cells touch one another, they are contact inhibited and stop growing. Transformed cells, however, are not contact inhibited and continue to grow to high densities in disorganized foci. Thus, transformed cells grow to a higher saturation density than corresponding normal cells. This is detected morphologically by the formation of a disoriented monolayer of cells or cells in foci. Alternatively, labeling index with ($^3$H)-thymidine at saturation density is used to measure density limitation of growth, similarly an MTT or Alamar blue assay will reveal proliferation capacity of cells and the the ability of modulators to affect same. See Freshney (1994), supra. Transformed cells, when transfected with tumor suppressor genes, can regenerate a normal phenotype and become contact inhibited and would grow to a lower density.

In this assay, labeling index with $^3$H-thymidine at saturation density is a preferred method of measuring density limitation of growth. Transformed host cells are transfected with a cancer-associated sequence and are grown for 24 hours at saturation density in non-limiting medium conditions. The percentage of cells labeling with ($^3$H)-thymidine is determined by incorporated cpm.

Contact independent growth is used to identify modulators of cancer sequences, which had led to abnormal cellular proliferation and transformation. A modulator reduces or eliminates contact independent growth, and returns the cells to a normal phenotype.

Evaluation of Growth Factor or Serum Dependence to Identify and Characterize Modulators Transformed cells have lower serum dependence than their normal counterparts (see, e.g., Temin, J. Natl. Cancer Inst. 37:167-175 (1966); Eagle et al., J. Exp. Med 131:836-879 (1970)); Freshney, supra. This is in part due to release of various growth factors by the transformed cells. The degree of growth factor or serum dependence of transformed host cells can be compared with that of control. For example, growth factor or serum dependence of a cell is monitored in methods to identify and characterize compounds that modulate cancer-associated sequences of the invention.

Use of Tumor-specific Marker Levels to Identify and Characterize Modulators

Tumor cells release an increased amount of certain factors (hereinafter "tumor specific markers") than their normal counterparts. For example, plasminogen activator (PA) is released from human glioma at a higher level than from normal brain cells (see, e.g., Gullino, Angiogenesis, Tumor Vascularization, and Potential Interference with Tumor Growth, in Biological Responses in Cancer, pp. 178-184 (Mihich (ed.) 1985)). Similarly, Tumor Angiogenesis Factor (TAF) is released at a higher level in tumor cells than their normal counterparts. See, e.g., Folkman, Angiogenesis and Cancer, Sem Cancer Biol. (1992)), while bFGF is released from endothelial tumors (Ensoli, B et al).

Various techniques which measure the release of these factors are described in Freshney (1994), supra. Also, see, Unkless et al., J. Biol. Chem. 249:4295-4305 (1974); Strickland & Beers, J. Biol. Chem. 251:5694-5702 (1976); Whur et al., Br. J. Cancer 42:305 312 (1980); Gullino, Angiogenesis, Tumor Vascularization, and Potential Interference with Tumor Growth, in Biological Responses in Cancer, pp. 178-184 (Mihich (ed.) 1985); Freshney, Anticancer Res. 5:111-130 (1985). For example, tumor specific marker levels are monitored in methods to identify and characterize compounds that modulate cancer-associated sequences of the invention.

Invasiveness into Matrigel to Identify and Characterize Modulators

The degree of invasiveness into Matrigel or an extracellular matrix constituent can be used as an assay to identify and characterize compounds that modulate cancer associated sequences. Tumor cells exhibit a positive correlation between malignancy and invasiveness of cells into Matrigel or some other extracellular matrix constituent. In this assay, tumorigenic cells are typically used as host cells. Expression of a tumor suppressor gene in these host cells would decrease invasiveness of the host cells. Techniques described in Cancer Res. 1999; 59:6010; Freshney (1994), supra, can be used. Briefly, the level of invasion of host cells is measured by using filters coated with Matrigel or some other extracellular matrix constituent. Penetration into the gel, or through to the distal side of the filter, is rated as invasiveness, and rated histologically by number of cells and distance moved, or by prelabeling the cells with $^{125}$1 and counting the radioactivity on the distal side of the filter or bottom of the dish. See, e.g., Freshney (1984), supra.

Evaluation of Tumor Growth In Vivo to Identify and Characterize Modulators

Effects of cancer-associated sequences on cell growth are tested in transgenic or immune-suppressed organisms. Transgenic organisms are prepared in a variety of art-accepted ways. For example, knock-out transgenic organisms, e.g., mammals such as mice, are made, in which a cancer gene is disrupted or in which a cancer gene is inserted. Knock-out transgenic mice are made by insertion of a marker gene or other heterologous gene into the endogenous cancer gene site in the mouse genome via homologous recombination. Such mice can also be made by substituting the endogenous cancer gene with a mutated version of the cancer gene, or by mutating the endogenous cancer gene, e.g., by exposure to carcinogens.

To prepare transgenic chimeric animals, e.g., mice, a DNA construct is introduced into the nuclei of embryonic stem cells. Cells containing the newly engineered genetic lesion are injected into a host mouse embryo, which is re-implanted into a recipient female. Some of these embryos develop into chimeric mice that possess germ cells some of which are derived from the mutant cell line. Therefore, by breeding the chimeric mice it is possible to obtain a new line of mice containing the introduced genetic lesion (see, e.g., Capecchi et al., Science 244:1288 (1989)). Chimeric mice can be derived according to U.S. Pat. No. 6,365,797, issued 2 Apr. 2002; U.S. Pat. No. 6,107,540 issued 22 Aug. 2000; Hogan et al., Manipulating the Mouse Embryo: A laboratory Manual, Cold Spring Harbor Laboratory (1988) and Teratocarcinomas and Embryonic Stem Cells: A Practical Approach, Robertson, ed., IRL Press, Washington, D.C., (1987).

Alternatively, various immune-suppressed or immune-deficient host animals can be used. For example, a genetically athymic "nude" mouse (see, e.g., Giovanella et al., J. Natl. Cancer Inst. 52:921 (1974)), a SCID mouse, a thymectornized mouse, or an irradiated mouse (see, e.g., Bradley et al., Br. J. Cancer 38:263 (1978); Selby et al., Br. J. Cancer 41:52 (1980)) can be used as a host. Transplantable tumor cells (typically about $10^6$ cells) injected into isogenic hosts produce invasive tumors in a high proportion of cases, while normal cells of similar origin will not. In hosts which developed invasive tumors, cells expressing cancer-associated sequences are injected subcutaneously or orthotopically. Mice are then separated into groups, including control groups and treated experimental groups) e.g. treated with a modulator). After a suitable length of time, preferably 4-8 weeks, tumor growth is measured (e.g., by volume or by its two largest dimensions, or weight) and compared to the control. Tumors that have statistically significant reduction (using, e.g., Student's T test) are said to have inhibited growth.

In Vitro Assays to Identify and Characterize Modulators

Assays to identify compounds with modulating activity can be performed in vitro. For example, a cancer polypeptide is first contacted with a potential modulator and incubated for a suitable amount of time, e.g., from 0.5 to 48 hours. In one embodiment, the cancer polypeptide levels are determined in vitro by measuring the level of protein or mRNA. The level of protein is measured using immunoassays such as Western blotting, ELISA and the like with an antibody that selectively binds to the cancer polypeptide or a fragment thereof. For measurement of mRNA, amplification, e.g., using PCR, LCR, or hybridization assays, e. g., Northern hybridization, RNAse protection, dot blotting, are preferred. The level of protein or mRNA is detected using directly or indirectly labeled detection agents, e.g., fluorescently or radioactively labeled nucleic acids, radioactively or enzymatically labeled antibodies, and the like, as described herein.

Alternatively, a reporter gene system can be devised using a cancer protein promoter operably linked to a reporter gene such as luciferase, green fluorescent protein, CAT, or β-gal. The reporter construct is typically transfected into a cell. After treatment with a potential modulator, the amount of reporter gene transcription, translation, or activity is measured according to standard techniques known to those of skill in the art (Davis G F, supra; Gonzalez, J. & Negulescu, P. Curr. Opin. Biotechnol. 1998: 9:624).

As outlined above, in vitro screens are done on individual genes and gene products. That is, having identified a particular differentially expressed gene as important in a particular state, screening of modulators of the expression of the gene or the gene product itself is performed.

In one embodiment, screening for modulators of expression of specific gene(s) is performed. Typically, the expression of only one or a few genes is evaluated. In another embodiment, screens are designed to first find compounds that bind to differentially expressed proteins. These compounds are then evaluated for the ability to modulate differentially expressed activity. Moreover, once initial candidate compounds are identified, variants can be further screened to better evaluate structure activity relationships.

Binding Assays to Identify and Characterize Modulators

In binding assays in accordance with the invention, a purified or isolated gene product of the invention is generally used. For example, antibodies are generated to a protein of the invention, and immunoassays are run to determine the amount and/or location of protein. Alternatively, cells comprising the cancer proteins are used in the assays.

Thus, the methods comprise combining a cancer protein of the invention and a candidate compound such as a ligand, and determining the binding of the compound to the cancer protein of the invention. Preferred embodiments utilize the human cancer protein; animal models of human disease of can also be developed and used. Also, other analogous mammalian proteins also can be used as appreciated by those of skill in the art. Moreover, in some embodiments variant or derivative cancer proteins are used.

Generally, the cancer protein of the invention, or the ligand, is non-diffusibly bound to an insoluble support. The support can, e.g., be one having isolated sample receiving areas (a microtiter plate, an array, etc.). The insoluble supports can be made of any composition to which the compositions can be bound, is readily separated from soluble material, and is otherwise compatible with the overall method of screening. The surface of such supports can be solid or porous and of any convenient shape.

Examples of suitable insoluble supports include microtiter plates, arrays, membranes and beads. These are typically made of glass, plastic (e.g., polystyrene), polysaccharide, nylon, nitrocellulose, or Teflon™, etc. Microtiter plates and arrays are especially convenient because a large number of assays can be carried out simultaneously, using small amounts of reagents and samples. The particular manner of binding of the composition to the support is not crucial so long as it is compatible with the reagents and overall methods of the invention, maintains the activity of the composition and is nondiffusable. Preferred methods of binding include the use of antibodies which do not sterically block either the ligand binding site or activation sequence when attaching the protein to the support, direct binding to "sticky" or ionic supports, chemical crosslinking, the synthesis of the protein or agent on the surface, etc. Following binding of the protein or ligand/binding agent to the support, excess unbound material is removed by washing. The sample receiving areas may then be blocked through incubation with bovine serum albumin (BSA), casein or other innocuous protein or other moiety.

Once a cancer protein of the invention is bound to the support, and a test compound is added to the assay. Alternatively, the candidate binding agent is bound to the support and the cancer protein of the invention is then added. Binding agents include specific antibodies, non-natural binding agents identified in screens of chemical libraries, peptide analogs, etc.

Of particular interest are assays to identify agents that have a low toxicity for human cells. A wide variety of assays can be used for this purpose, including proliferation assays, cAMP assays, labeled in vitro protein-protein binding assays, electrophoretic mobility shift assays, immunoassays for protein binding, functional assays (phosphorylation assays, etc.) and the like.

A determination of binding of the test compound (ligand, binding agent, modulator, etc.) to a cancer protein of the invention can be done in a number of ways. The test compound can be labeled, and binding determined directly, e.g., by attaching all or a portion of the cancer protein of the invention to a solid support, adding a labeled candidate compound (e.g., a fluorescent label), washing off excess reagent, and determining whether the label is present on the solid support. Various blocking and washing steps can be utilized as appropriate.

In certain embodiments, only one of the components is labeled, e.g., a protein of the invention or ligands labeled.

Alternatively, more than one component is labeled with different labels, e.g., $I^{125}$, for the proteins and a fluorophor for the compound. Proximity reagents, e.g., quenching or energy transfer reagents are also useful.

Competitive Binding to Identify and Characterize Modulators

In one embodiment, the binding of the "test compound" is determined by competitive binding assay with a "competitor." The competitor is a binding moiety that binds to the target molecule (e.g., a cancer protein of the invention). Competitors include compounds such as antibodies, peptides, binding partners, ligands, etc. Under certain circumstances, the competitive binding between the test compound and the competitor displaces the test compound. In one embodiment, the test compound is labeled. Either the test compound, the competitor, or both, is added to the protein for a time sufficient to allow binding. Incubations are performed at a temperature that facilitates optimal activity, typically between four and 40° C. Incubation periods are typically optimized, e.g., to facilitate rapid high throughput screening; typically between zero and one hour will be sufficient. Excess reagent is generally removed or washed away. The second component is then added, and the presence or absence of the labeled component is followed, to indicate binding.

In one embodiment, the competitor is added first, followed by the test compound. Displacement of the competitor is an indication that the test compound is binding to the cancer protein and thus is capable of binding to, and potentially modulating, the activity of the cancer protein. In this embodiment, either component can be labeled. Thus, e.g., if the competitor is labeled, the presence of label in the post-test compound wash solution indicates displacement by the test compound. Alternatively, if the test compound is labeled, the presence of the label on the support indicates displacement.

In an alternative embodiment, the test compound is added first, with incubation and washing, followed by the competitor. The absence of binding by the competitor indicates that the test compound binds to the cancer protein with higher affinity than the competitor. Thus, if the test compound is labeled, the presence of the label on the support, coupled with a lack of competitor binding, indicates that the test compound binds to and thus potentially modulates the cancer protein of the invention.

Accordingly, the competitive binding methods comprise differential screening to identity agents that are capable of modulating the activity of the cancer proteins of the invention. In this embodiment, the methods comprise combining a cancer protein and a competitor in a first sample. A second sample comprises a test compound, the cancer protein, and a competitor. The binding of the competitor is determined for both samples, and a change, or difference in binding between the two samples indicates the presence of an agent capable of binding to the cancer protein and potentially modulating its activity. That is, if the binding of the competitor is different in the second sample relative to the first sample, the agent is capable of binding to the cancer protein.

Alternatively, differential screening is used to identify drug candidates that bind to the native cancer protein, but cannot bind to modified cancer proteins. For example the structure of the cancer protein is modeled and used in rational drug design to synthesize agents that interact with that site, agents which generally do not bind to site-modified proteins. Moreover, such drug candidates that affect the activity of a native cancer protein are also identified by screening drugs for the ability to either enhance or reduce the activity of such proteins.

Positive controls and negative controls can be used in the assays. Preferably control and test samples are performed in at least triplicate to obtain statistically significant results. Incubation of all samples occurs for a time sufficient to allow for the binding of the agent to the protein. Following incubation, samples are washed free of non-specifically bound material and the amount of bound, generally labeled agent determined. For example, where a radiolabel is employed, the samples can be counted in a scintillation counter to determine the amount of bound compound.

A variety of other reagents can be included in the screening assays. These include reagents like salts, neutral proteins, e.g. albumin, detergents, etc. which are used to facilitate optimal protein-protein binding and/or reduce non-specific or background interactions. Also reagents that otherwise improve the efficiency of the assay, such as protease inhibitors, nuclease inhibitors, anti-microbial agents, etc., can be used. The mixture of components is added in an order that provides for the requisite binding.

Use of Polynucleotides to Down-regulate or Inhibit a Protein of the Invention.

Polynucleotide modulators of cancer can be introduced into a cell containing the target nucleotide sequence by formation of a conjugate with a ligand-binding molecule, as described in WO 91/04753. Suitable ligand-binding molecules include, but are not limited to, cell surface receptors, growth factors, other cytokines, or other ligands that bind to cell surface receptors. Preferably, conjugation of the ligand binding molecule does not substantially interfere with the ability of the ligand binding molecule to bind to its corresponding molecule or receptor, or block entry of the sense or antisense oligonucleotide or its conjugated version into the cell. Alternatively, a polynucleotide modulator of cancer can be introduced into a cell containing the target nucleic acid sequence, e.g., by formation of a polynucleotide-lipid complex, as described in WO 90/10448. It is understood that the use of antisense molecules or knock out and knock in models may also be used in screening assays as discussed above, in addition to methods of treatment.

Inhibitory and Antisense Nucleotides

In certain embodiments, the activity of a cancer-associated protein is down-regulated, or entirely inhibited, by the use of antisense polynucleotide or inhibitory small nuclear RNA (snRNA), i.e., a nucleic acid complementary to, and which can preferably hybridize specifically to, a coding mRNA nucleic acid sequence, e.g., a cancer protein of the invention, mRNA, or a subsequence thereof. Binding of the antisense polynucleotide to the mRNA reduces the translation and/or stability of the mRNA.

In the context of this invention, antisense polynucleotides can comprise naturally occurring nucleotides, or synthetic species formed from naturally occurring subunits or their close homologs. Antisense polynucleotides may also have altered sugar moieties or inter-sugar linkages. Exemplary among these are the phosphorothioate and other sulfur containing species which are known for use in the art. Analogs are comprised by this invention so long as they function effectively to hybridize with nucleotides of the invention. See, e.g., Isis Pharmaceuticals, Carlsbad, Calif.; Sequitor, Inc., Natick, Mass.

Such antisense polynucleotides can readily be synthesized using recombinant means, or can be synthesized in vitro. Equipment for such synthesis is sold by several vendors, including Applied Biosystems. The preparation of other oligonucleotides such as phosphorothioates and alkylated derivatives is also well known to those of skill in the art.

Antisense molecules as used herein include antisense or sense oligonucleotides. Sense oligonucleotides can, e.g., be employed to block transcription by binding to the anti-sense strand. The antisense and sense oligonucleotide comprise a single stranded nucleic acid sequence (either RNA or DNA) capable of binding to target mRNA (sense) or DNA (antisense) sequences for cancer molecules. Antisense or sense oligonucleotides, according to the present invention, comprise a fragment generally at least about 12 nucleotides, preferably from about 12 to 30 nucleotides. The ability to derive an antisense or a sense oligonucleotide, based upon a cDNA sequence encoding a given protein is described in, e.g., Stein &Cohen (Cancer Res. 48:2659 (1988 and van der Krol et al. (BioTechniques 6:958 (1988)).

Ribozymes

In addition to antisense polynucleotides, ribozymes can be used to target and inhibit transcription of cancer-associated nucleotide sequences. A ribozyme is an RNA molecule that catalytically cleaves other RNA molecules. Different kinds of ribozymes have been described, including group I ribozymes, hammerhead ribozymes, hairpin ribozymes, RNase P, and axhead ribozymes (see, e.g., Castanotto et al., Adv. in Pharmacology 25: 289-317 (1994) for a general review of the properties of different ribozymes).

The general features of hairpin ribozymes are described, e.g., in Hampel et al., Nucl. Acids Res. 18:299-304 (1990); European Patent Publication No. 0360257; U.S. Pat. No. 5,254,678. Methods of preparing are well known to those of skill in the art (see, e.g., WO 94/26877; Ojwang et al., Proc. Natl. Acad. Sci. USA 90:6340-6344 (1993); Yamada et al., Human Gene Therapy 1:39-45 (1994); Leavitt et al., Proc. Natl. Acad Sci. USA 92:699-703 (1995); Leavitt et al., Human Gene Therapy 5: 1151-120 (1994); and Yamada et al., Virology 205: 121-126 (1994)).

Use of Modulators in Phenotypic Screening

In one embodiment, a test compound is administered to a population of cancer cells, which have an associated cancer expression profile. By "administration" or "contacting" herein is meant that the modulator is added to the cells in such a manner as to allow the modulator to act upon the cell, whether by uptake and intracellular action, or by action at the cell surface. In some embodiments, a nucleic acid encoding a proteinaceous agent (i.e., a peptide) is put into a viral construct such as an adenoviral or retroviral construct, and added to the cell, such that expression of the peptide agent is accomplished, e.g., PCT US97/01019. Regulatable gene therapy systems can also be used. Once the modulator has been administered to the cells, the cells are washed if desired and are allowed to incubate under preferably physiological conditions for some period. The cells are then harvested and a new gene expression profile is generated. Thus, e.g., cancer tissue is screened for agents that modulate, e.g., induce or suppress, the cancer phenotype. A change in at least one gene, preferably many, of the expression profile indicates that the agent has an effect on cancer activity. Similarly, altering a biological function or a signaling pathway is indicative of modulator activity. By defining such a signature for the cancer phenotype, screens for new drugs that alter the phenotype are devised. With this approach, the drug target need not be known and need not be represented in the original gene/ protein expression screening platform, nor does the level of transcript for the target protein need to change. The modulator inhibiting function will serve as a surrogate marker As outlined above, screens are done to assess genes or gene products. That is, having identified a particular differentially expressed gene as important in a particular state, screening of modulators of either the expression of the gene or the gene product itself is performed.

Use of Modulators to Affect Peptides of the Invention

Measurements of cancer polypeptide activity, or of the cancer phenotype are performed using a variety of assays. For example, the effects of modulators upon the function of a cancer polypeptide(s) are measured by examining parameters described above. A physiological change that affects activity is used to assess the influence of a test compound on the polypeptides of this invention. When the functional outcomes are determined using intact cells or animals, a variety of effects can be assesses such as, in the case of a cancer associated with solid tumors, tumor growth, tumor metastasis, neovascularization, hormone release, transcriptional changes to both known and uncharacterized genetic markers (e.g., by Northern blots), changes in cell metabolism such as cell growth or pH changes, and changes in intracellular second messengers such as cGNIP.

Methods of Identifying Characterizing Cancer-associated Sequences

Expression of various gene sequences is correlated with cancer. Accordingly, disorders based on mutant or variant cancer genes are determined. In one embodiment, the invention provides methods for identifying cells containing variant cancer genes, e.g., determining the presence of, all or part, the sequence of at least one endogenous cancer gene in a cell. This is accomplished using any number of sequencing techniques. The invention comprises methods of identifying the cancer genotype of an individual, e.g., determining all or part of the sequence of at least one gene of the invention in the individual. This is generally done in at least one tissue of the individual, e.g., a tissue set forth in Table I, and may include the evaluation of a number of tissues or different samples of the same tissue. The method may include comparing the sequence of the sequenced gene to a known cancer gene, i.e., a wild-type gene to determine the presence of family members, homologies, mutations or variants. The sequence of all or part of the gene can then be compared to the sequence of a known cancer gene to determine if any differences exist. This is done using any number of known homology programs, such as BLAST, Bestfit, etc. The presence of a difference in the sequence between the cancer gene of the patient and the known cancer gene correlates with a disease state or a propensity for a disease state, as outlined herein.

In a preferred embodiment, the cancer genes are used as probes to determine the number of copies of the cancer gene in the genome. The cancer genes are used as probes to determine the chromosomal localization of the cancer genes. Information such as chromosomal localization finds use in providing a diagnosis or prognosis in particular when chromosomal abnormalities such as translocations, and the like are identified in the cancer gene locus.

XIV.) Kits/Articles of Manufacture

For use in the laboratory, prognostic, prophylactic, diagnostic and therapeutic applications described herein, kits are within the scope of the invention. Such kits can comprise a carrier, package, or container that is compartmentalized to receive one or more containers such as vials, tubes, and the like, each of the container(s) comprising one of the separate elements to be used in the method, along with a label or insert comprising instructions for use, such as a use described herein. For example, the container(s) can comprise a probe that is or can be detectably labeled. Such probe can be an antibody or polynucleotide specific for a protein or a gene or message of the invention, respectively. Where the method utilizes nucleic acid hybridization to detect the target nucleic acid, the kit can also have containers containing nucleotide(s) for amplification of the target nucleic acid sequence. Kits can comprise a container comprising a reporter, such as a biotin-binding protein, such as avidin or streptavidin, bound to a reporter molecule, such as an enzymatic, fluorescent, or radioisotope label; such a reporter can be used with, e.g., a nucleic acid or antibody. The kit can include all or part of the amino acid sequences in FIG. 2 or FIG. 3 or analogs thereof, or a nucleic acid molecule that encodes such amino acid sequences.

The kit of the invention will typically comprise the container described above and one or more other containers associated therewith that comprise materials desirable from a commercial and user standpoint, including buffers, diluents, filters, needles, syringes; carrier, package, container, vial and/or tube labels listing contents and/or instructions for use, and package inserts with instructions for use.

A label can be present on or with the container to indicate that the composition is used for a specific therapy or non-therapeutic application, such as a prognostic, prophylactic, diagnostic or laboratory application, and can also indicate directions for either in vivo or in vitro use, such as those described herein. Directions and or other information can also be included on an insert(s) or label(s) which is included with or on the kit. The label can be on or associated with the container. A label a can be on a container when letters, numbers or other characters forming the label are molded or etched into the container itself; a label can be associated with a container when it is present within a receptacle or carrier that also holds the container, e.g., as a package insert. The label can indicate that the composition is used for diagnosing, treating, prophylaxing or prognosing a condition, such as a neoplasia of a tissue set forth in Table I.

The terms "kit" and "article of manufacture" can be used as synonyms.

In another embodiment of the invention, an article(s) of manufacture containing compositions, such as amino acid sequence(s), small molecule(s), nucleic acid sequence(s), and/or antibody(s), e.g., materials useful for the diagnosis, prognosis, prophylaxis and/or treatment of neoplasias of tissues such as those set forth in Table I is provided. The article of manufacture typically comprises at least one container and at least one label. Suitable containers include, for example, bottles, vials, syringes, and test tubes. The containers can be formed from a variety of materials such as glass, metal or plastic. The container can hold amino acid sequence(s), small molecule(s), nucleic acid sequence(s), cell population(s) and/or antibody(s). In one embodiment, the container holds a polynucleotide for use in examining the mRNA expression profile of a cell, together with reagents used for this purpose. In another embodiment a container comprises an antibody, binding fragment thereof or specific binding protein for use in evaluating protein expression of 282P1G3 in cells and tissues, or for relevant laboratory, prognostic, diagnostic, prophylactic and therapeutic purposes; indications and/or directions for such uses can be included on or with such container, as can reagents and other compositions or tools used for these purposes. In another embodiment, a container comprises materials for eliciting a cellular or humoral immune response, together with associated indications and/or directions. In another embodiment, a container comprises materials for adoptive immunotherapy, such as cytotoxic T cells (CTL) or helper T cells (HTL), together with associated indications and/or directions; reagents and other compositions or tools used for such purpose can also be included.

The container can alternatively hold a composition that is effective for treating, diagnosis, prognosing or prophylaxing a condition and can have a sterile access port (for example the container can be an intravenous solution bag or a vial having a stopper pierceable by a hypodermic injection needle). The active agents in the composition can be an antibody capable of specifically binding 282P1G3 and modulating the function of 282P1G3.

The article of manufacture can further comprise a second container comprising a pharmaceutically-acceptable buffer, such as phosphate-buffered saline, Ringer's solution and/or dextrose solution. It can further include other materials desirable from a commercial and user standpoint, including other buffers, diluents, filters, stirrers, needles, syringes, and/or package inserts with indications and/or instructions for use.

EXAMPLES

Various aspects of the invention are further described and illustrated by way of the several examples that follow, none of which is intended to limit the scope of the invention.

Example 1

SSH-Generated Isolation of cDNA Fragment of the PSCA Gene

Intentionally Omitted

Example 2

Isolation of Full Length PSCA Encoding cDNA

Intentionally Omitted

Example 3

Chromosomal Mapping of PSCA

Intentionally Omitted

Example 4

Expression Analysis of PSCA Variants in Normal Tissues and Patient Specimens

Previously, PSCA, herein referred to as PSCA v.1, was identified as an antigen expressed in prostate cancer. Its expression was detected in greater than 80% of primary prostate cancers and in the majority of prostate metastasis. It has also been shown to be expressed in bladder cancer, ovary cancer, and pancreatic cancer; these cancers are listed in Table I. By immunohistochemical analysis, PSCA has been shown to be overexpressed on the cell surface of most urothelial transitional carcinoma, and in 60% of primary pancreatic adenocarcinomas. The PSCA expression data has been reported in patent publications (PCT/US98/04664, PCT/US/28883, PCT/US00/19967) and in peer-reviewed articles (Saffran et al., Proc Natl Acad Sci U S A. 2001 Feb. 27; 98(5): 2658-2663; Amara et al., Cancer Res. 2001 Jun. 15; 61(12): 4660-65; Reiter et al., Proc Natl Acad Sci USA. 1998 Feb. 17; 95(4): 1735-40; Argani et al., Cancer Res. 2001 Jun. 1; 61(11): 4320-24).

Specific expression of different PSCA variants was studied in normal and cancer patient specimens (FIG. 14 and FIG. 1). Primers were designed to differentiate between PSCA v.1/v.2/v.4, PSCA v.3 and PSCA v.5. PSCA v.1/v.2/v.4 lead to a PCR product of 425 bp, PSCA v.3 leads to a PCR product of 300 bp, whereas PSCA v.5 leads to a PCR product of 910 bp in size (FIG. 14A).

First strand cDNA was prepared from normal bladder, brain, heart, kidney, liver, lung, prostate, spleen, skeletal muscle, testis, pancreas, colon, stomach, pools of prostate cancer, bladder cancer, kidney cancer, colon cancer, lung cancer, ovary cancer, breast cancer, cancer metastasis, and pancreas cancer (FIG. 14B). Normalization was performed by PCR using primers to actin. Semi-quantitative PCR, using the variant specific primers was performed at 30 cycles of amplification.

Results show expression of PSCA v.5 mainly in breast cancer, cancer metastasis, and pancreas cancer, and at lower level in colon cancer and lung cancer. PSCA v.1/v.2/v.4 PCR product was detected in prostate cancer, bladder cancer, kidney cancer, colon cancer, lung cancer, ovary cancer, breast cancer, cancer metastasis, and pancreas cancer. Amongst normal tissues, PSCA v.1/v.2/v.4 PCR product was detected only in prostate, stomach and at lower level in kidney and lung, whereas PSCA v.5 was not detected in any normal tissue. PSCA v.3 PCR detected product was not detected in any of the samples tested.

Primers were designed to differentiate between PSCA v.4 and PSCA v.5 (FIG. 1A). PSCA v.4 lead to a PCR product of 460 bp, whereas PSCA v.5 lead to a PCR product of 945 bp in size.

First strand cDNA was prepared from normal bladder, brain, heart, kidney, liver, lung, prostate, spleen, skeletal muscle, testis, pancreas, colon, stomach, pools of prostate cancer, bladder cancer, and multi-xenograft pool (prostate cancer, kidney cancer and bladder cancer xenografts) (FIG. 1B). Normalization was performed by PCR using primers to actin. Semi-quantitative PCR, using the variant specific primers was performed at 30 cycles of amplification.

Results show expression of PSCA v.4 in prostate cancer, bladder cancer, and multi-xenograft pool, normal kidney and prostate. PSCA v.5 was detected only in normal prostate and bladder cancer.

The restricted expression of PSCA variants in normal tissues and the expression detected in cancer patient specimens indicate that PSCA variants are therapeutic, prognostic, laboratory, prophylactic, and diagnostic targets for human cancers.

Example 5

Transcript Variants of PSCA

As used herein, the term variant includes transcript variants and single nucleotide polymorphisms (SNPs). Transcript variants are variants of mature mRNA from the same gene which arise by alternative transcription or alternative splicing. Alternative transcripts are transcripts from the same gene but start transcription at different points. Splice variants are mRNA variants spliced differently from the same transcript. In eukaryotes, when a multi-exon gene is transcribed from genomic DNA, the initial RNA is spliced to produce functional mRNA, which has only exons and is used for translation into an amino acid sequence. Accordingly, a given gene can have zero to many alternative transcripts and each transcript can have zero to many splice variants. Each transcript variant has a unique exon makeup, and can have different coding and/or non-coding (5' or 3' end) portions, from the original transcript. Transcript variants can code for the same, similar or different proteins, such proteins having the same or a similar function or a different function. The variant proteins can be expressed in the same tissue at the same time, in a different tissue at the same time, or in the same tissue at different times, or in a different tissue at a different time. Proteins encoded by a transcript variant can have similar or different subcellular or extracellular localizations (e.g., secreted versus intracellular).

Transcript variants are identified by a variety of art-accepted methods. For example, alternative transcripts and splice variants are identified by full-length cloning, or by use of full-length transcript and EST sequences. First, all human ESTs were grouped into clusters which show direct or indirect identity with each other. Second, ESTs in the same cluster were further grouped into sub-clusters and assembled into a consensus sequence. The original gene sequence is compared to the consensus sequence(s) or other full-length sequences. Each consensus sequence is a potential splice variant for that gene. Several confirmation modalities are known in the art, such as identification of the variant by Northern analysis, full length cloning or by use of probe libraries, etc.. Even when a variant is identified that is not yet a full-length clone, that portion of the variant is very useful as a research tool, e.g., for antigen generation or for further cloning of the full-length splice variant, using techniques known in the art.

Moreover, computer programs are available in the art that identify transcript variants based on genomic sequences. Genomic-based transcript variant identification programs include FgenesH (A. Salamov and V. Solovyev, "Ab initio gene finding in Drosophila genomic DNA," Genome Research. 2000 Apr.; 10(4):516-22); Grail (URL compbio.ornl.gov/Grail-bin/EmptyGrailForm) and GenScan (URL genes.mit.edu/GENSCAN.html). For a general discussion of splice variant identification protocols see, e.g., Southan, C., A genomic perspective on human proteases, FEBS Lett. 2001 Jun. 8; 498(2-3):214-8; de Souza, S. J., et al., Identification of human chromosome 22 transcribed sequences with ORF expressed sequence tags, Proc. Natl Acad Sci U S A. 2000 Nov. 7; 97(23):12690-3.

To further confirm the parameters of a transcript variant, a variety of techniques are available in the art, such as full-length cloning, proteomic validation, PCR-based validation, and 5' RACE validation, etc. (see e.g., Proteomic Validation: Brennan, S. O., et al., Albumin banks peninsula: a new termination variant characterized by electrospray mass spectrometry, Biochem Biophys Acta. 1999 Aug. 17;1433(1-2): 321-6; Ferranti P, et al., Differential splicing of pre-messenger RNA produces multiple forms of mature caprine alpha(s1)-casein, Eur J Biochem. 1997 Oct. 1;249(1):1-7. For PCR-based Validation: Wellmann S, et al., Specific reverse transcription-PCR quantification of vascular endothelial growth factor (VEGF) splice variants by LightCycler technology, Clin Chem. 2001 April;47(4):654-60; Jia, H. P., et al., Discovery of new human beta-defensins using a genomics-based approach, Gene. 2001 Jan. 24; 263(1-2):211-8. For PCR-based and 5' RACE Validation: Brigle, K. E., et al., Organization of the murine reduced folate carrier gene and identification of variant splice forms, Biochem Biophys Acta. 1997 Aug. 7; 1353(2): 191-8).

It is known in the art that genomic regions are modulated in cancers. When the genomic region to which a gene maps is modulated in a particular cancer, the alternative transcripts or splice variants of the gene are modulated as well. Disclosed herein is that PSCA has a particular expression profile related to cancer (see, e.g., Table I). Alternative transcripts and splice variants of PSCA are also involved in cancers, for example in one or more of these tissues and in certain additional tissues as well. The variants thus serve as tumor-associated markers/ antigens.

Using the full-length PSCA gene together with EST sequences, four additional transcript variants were identified, designated as PSCA v.2, v.3, v.4, and v.5. The boundaries of exons in the original transcript, PSCA v.1 were shown in Table LI. Schematic structures of the transcript variant nucleic acid sequences are shown in FIG. 10. In FIG. 10, bars with the same graphic pattern depict stretches of contiguous genetic material, e.g., the black bars designate genomic sequence found in variant 1.

Tables LII(a)-(d) through LV(a)-(d) are set forth on a variant-by-variant basis. LII(a)-(d) shows the nucleotide sequences of the transcript variants. Table LIII(a)-(d) shows the alignment of the transcript variants with nucleic acid sequence of PSCA v.1 (for v.2 only) or with PSCAv.2 (for all other variants). Table LIV(a)-(d) present the amino acid translation of the transcript variants for the identified reading frame orientation. Table LV(a)-(d) displays alignments of the amino acid sequence encoded by the splice variant with that of PSCA v.1.

Example 6

Single Nucleotide Polymorphisms of PSCA

A Single Nucleotide Polymorphism (SNP) is a single base pair variation in a nucleotide sequence at a specific location. At any given point of the genome, there are four possible nucleotide base pairs: A/T, C/G, G/C, and T/A. As used herein, an allele is one of a series of alternative forms of a given gene, differing in DNA sequence, and affecting a product (RNA and/or protein).

A SNP that occurs on a cDNA is called a cSNP. This cSNP may change amino acids of the protein encoded by the gene and thus change the function of the protein. Some SNPs cause inherited diseases; others contribute to quantitative variations in phenotype and reactions to environmental factors including diet and drugs among individuals. Therefore, the existence of a SNP and/or combinations of alleles (called haplotypes) have many useful applications, such as diagnosis of inherited diseases, determination of drug reactions and dosage, identification of genes responsible for diseases, and analysis of the genetic relationship between individuals (P. Nowotny, J. M. Kwon and A. M. Goate, "SNP analysis to dissect human traits," Curr. Opin. Neurobiol. 2001 Oct.; 11(5):637-641; M. Pirmohamed and B. K. Park, "Genetic susceptibility to adverse drug reactions," Trends Pharmacol. Sci. 2001 Jun.; 22(6):298-305; J. H. Riley, C. J. Allan, E. Lai and A. Roses, "The use of single nucleotide polymorphisms in the isolation of common disease genes," Pharmacogenomics. 2000 Feb.; 1(1):39-47; R. Judson, J. C. Stephens and A. Windemuth, "The predictive power of haplotypes in clinical response," Pharmacogenomics. 2000 Feb.; 1(1):15-26).

SNPs are identified by a variety of art-accepted methods (P. Bean, "The promising voyage of SNP target discovery," Am. Clin. Lab. 2001 October-November; 20(9):18-20; K. M. Weiss, "In search of human variation," Genome Res. 1998 Jul.; 8(7):691-697; M. M. She, "Enabling large-scale pharmacogenetic studies by high-throughput mutation detection and genotyping technologies," Clin. Chem. 2001 February; 47(2):164-172). For example, SNPs are identified by sequencing DNA fragments that show polymorphism by gel-based methods such as restriction fragment length polymorphism (RFLP) and denaturing gradient gel electrophoresis (DGGE). They are also discovered by direct sequencing of DNA samples pooled from different individuals or by comparing sequences from different DNA samples. With the rapid accumulation of sequence data in public and private databases, one also discovers SNPs by comparing sequences using computer programs (Z. Gu, L. Hillier and P. Y. Kwok, "Single nucleotide polymorphism hunting in cyberspace," Hum. Mutat. 1998; 12(4):221-225). SNPs can be verified and the genotype or haplotype of an individual can be determined by a variety of methods including direct sequencing and high throughput microarrays (P. Y. Kwok, "Methods for genotyping single nucleotide polymorphisms," Annu. Rev. Genomics Hum. Genet. 2001; 2:235-258; M. Kokoris, K. Dix, K. Moynihan, J. Mathis, B. Erwin, P. Grass, B. Hines and A. Duesterhoeft, "High-throughput SNP genotyping with the Masscode system," Mol. Diagn. 2000 Dec.; 5(4):329-340).

Using the methods described above, thirteen SNP were identified in the transcript for PSCA v.2. Variant 2 was used, rather than for example variant 1, as it had fewer ambiguous bases than variant 1. Accordingly, SNPs were identified in PSCA v.2, at positions 57 (t/c), 367 (c/t), 424 (a/c), 495 (c/g), 499 (c/t), 563 (c/t), 567 (g/a), 627 (g/a), 634 (t/g), 835 (g/a), 847 (g/a), 878 (g/a), and 978 (c/g). The transcripts or proteins with alternative alleles were designated as variant PSCA v.6 through v.18, as shown in Table LVI and FIG. 12a.

The nucleotide change in v.6 changed the start codon of v.1 and thus, the translation would not start until the next ATG (AUG in mRNA), resulting in a protein 9 AA shorter than v.1 protein (FIG. 11a). The nucleotide changes for v.7 and v.8 were silent at the protein level.

Figures 1, 12B:
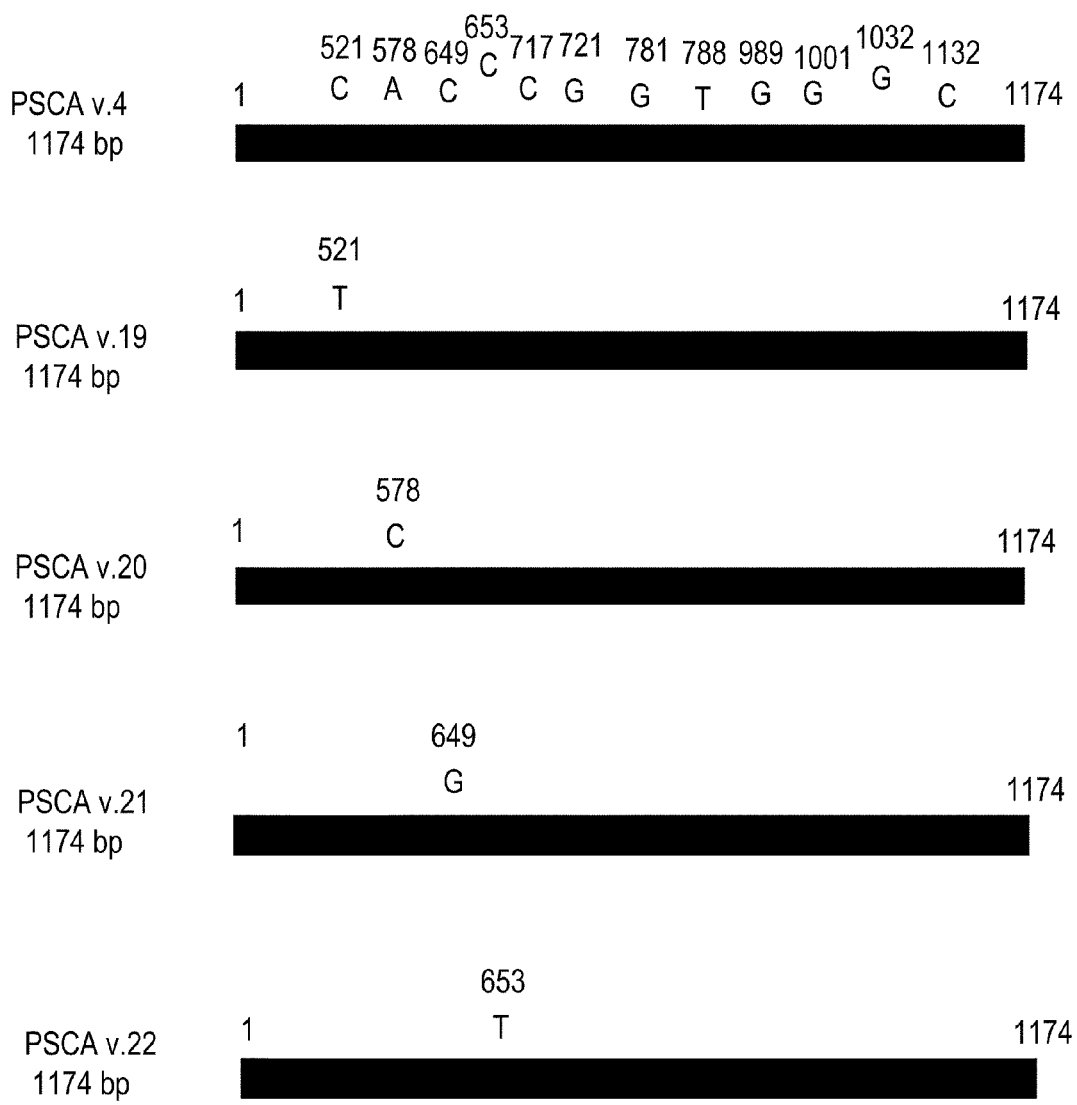
Figures 2, 12B:
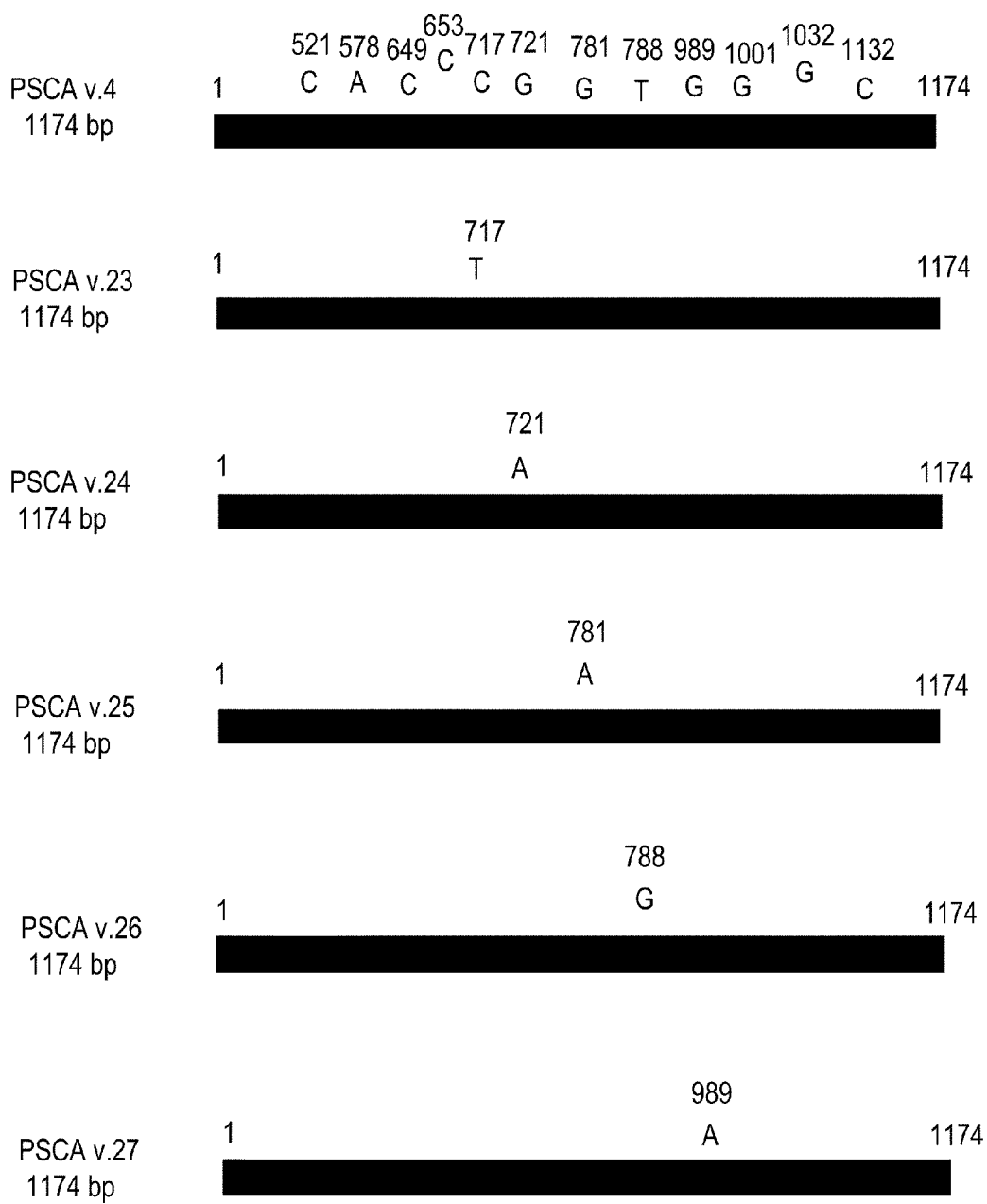
Figures 3, 12B:
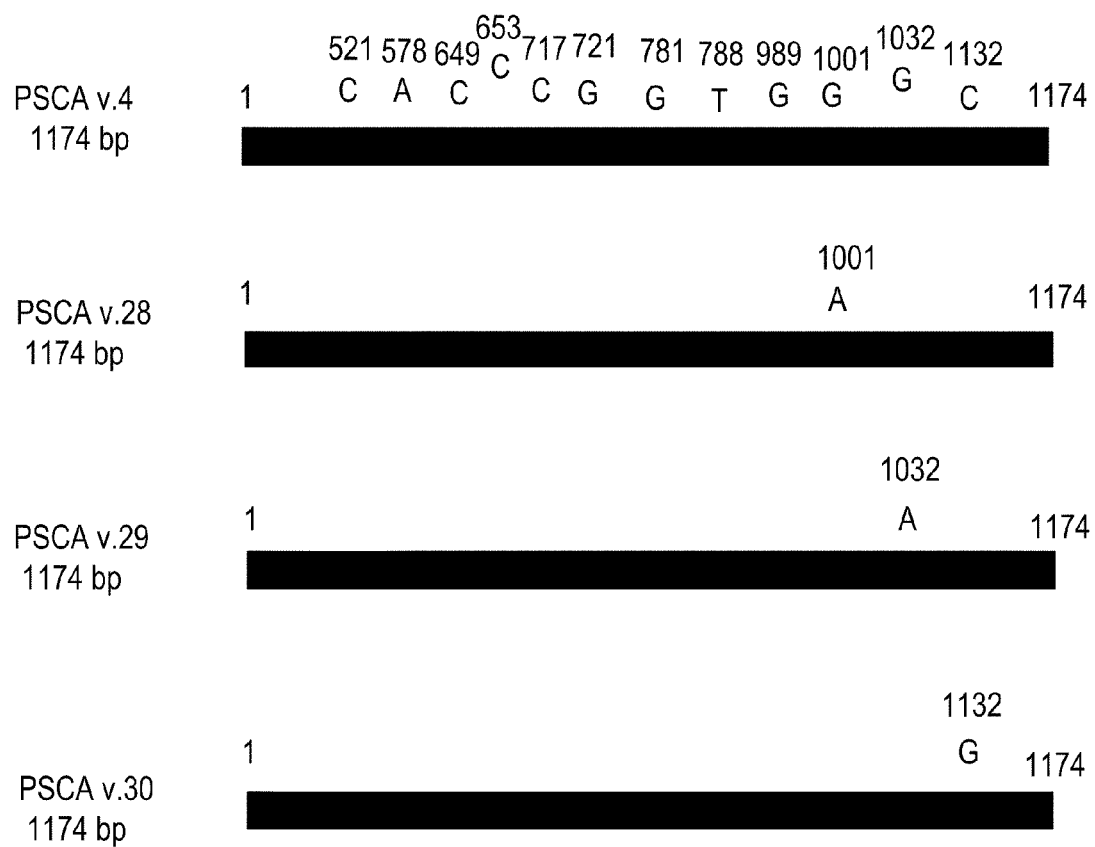
Figure 13E:
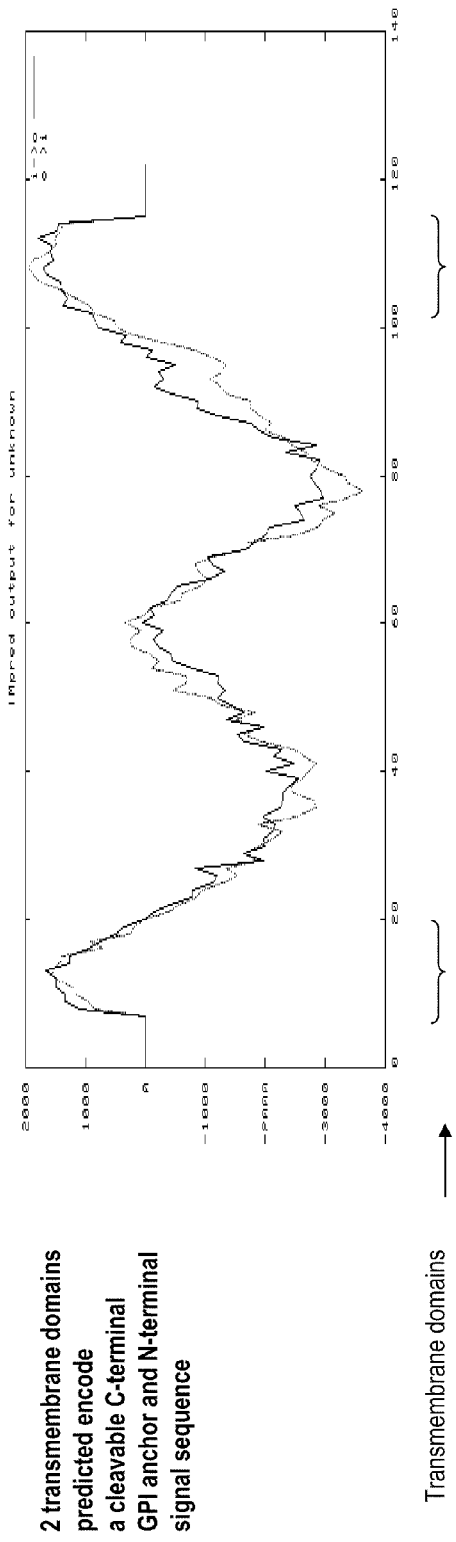
Figure 13F:
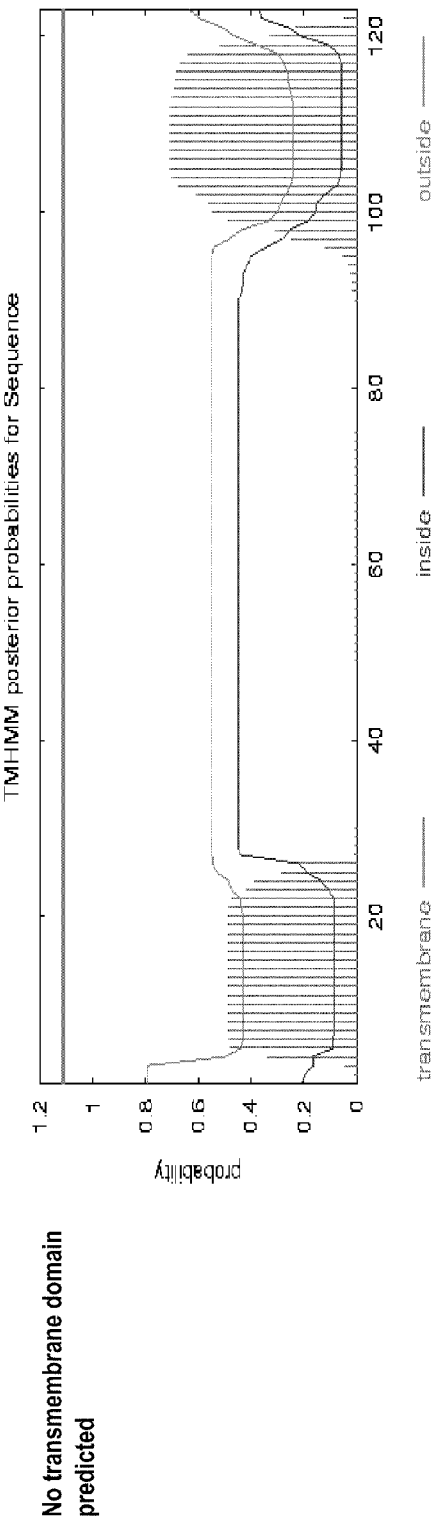
Figure 13G:
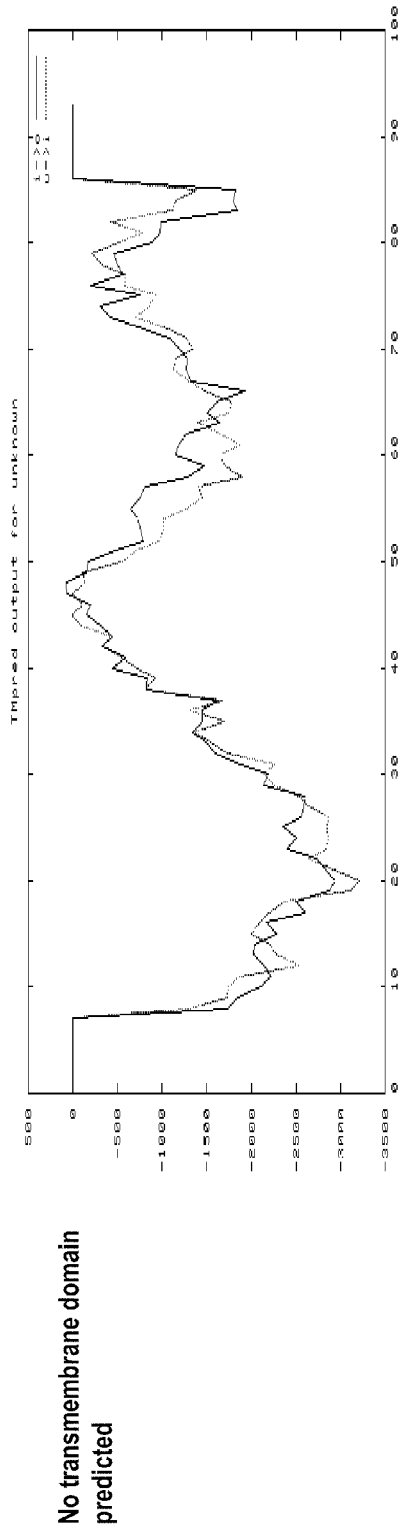
Figure 13H:
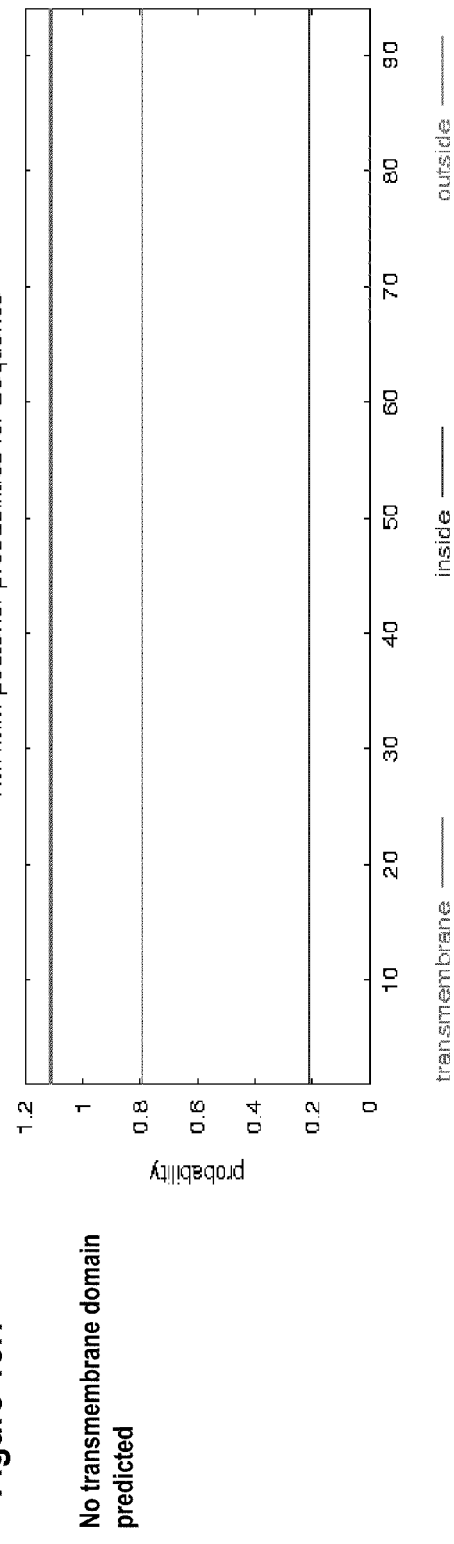
Figure 13I:
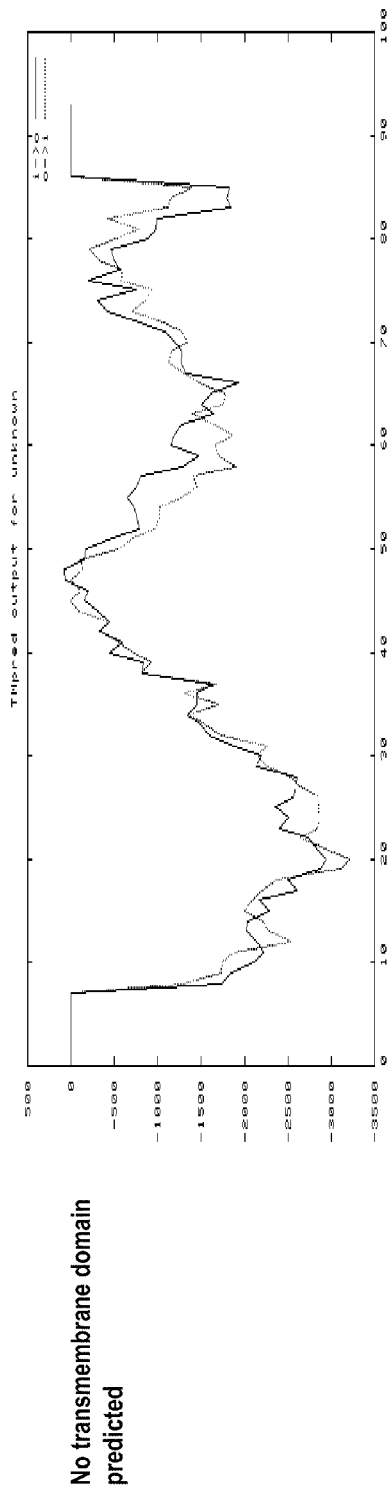
Figure 13J:
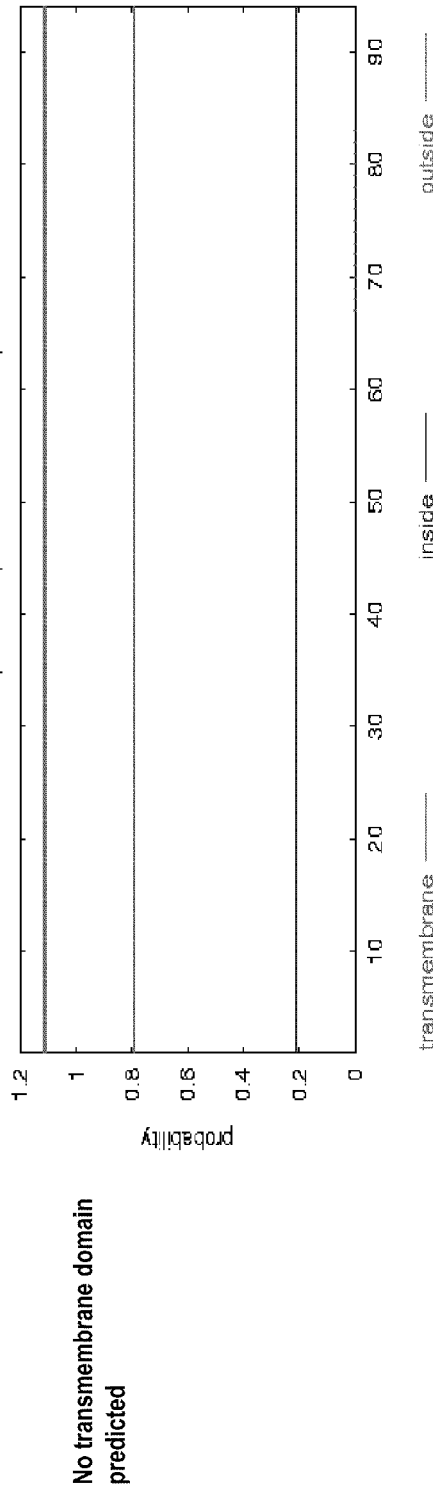
Figure 13K:
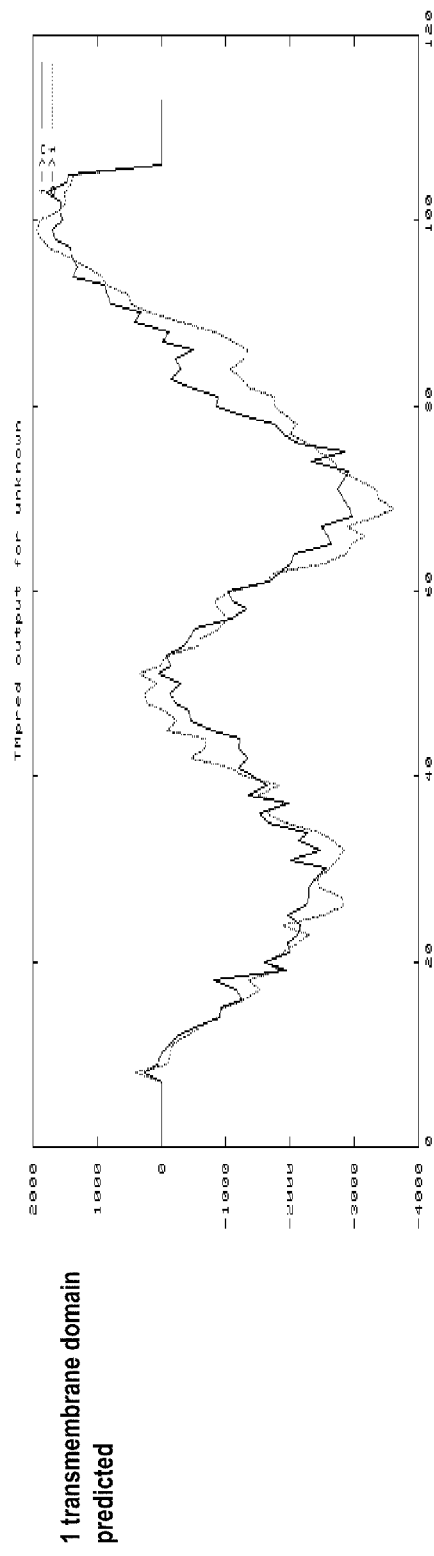
Figure 13L:
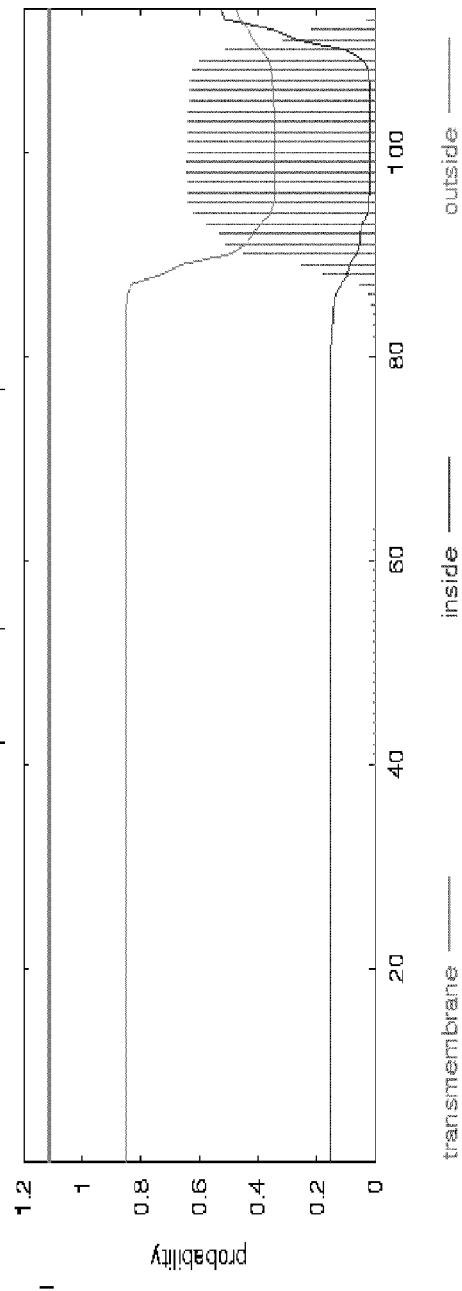

Twelve of these 13 SNPs were also present in variant 4 as set forth in FIG. 12b and table LVI. The 12 SNP variants relative to PSCA v.4 are designated PSCA v.19 through v.30. Variants 19 through 27 encode alternative amino acids. (FIG. 11b and Table LVI).

Table LVI also shows the amino acid changes of protein sequence. These SNP, though shown individually separately here, can occur in different combinations and in any one of the transcript variants that contains the site of the SNP.

Example 7

Production of Recombinant PSCA in Prokaryotic Systems

To express recombinant PSCA and PSCA variants in prokaryotic cells, the full or partial length PSCA and PSCA variant cDNA sequences are cloned into any one of a variety of expression vectors known in the art. One or more of the following regions of PSCA variants are expressed: the full length sequence presented in FIGS. 2 and 3, or any 8, 9, 10, 11, 12, 13, 14, 15, 16, 17, 18, 19, 20, 21, 22, 23, 24, 25, 26, 27, 28, 29, 30 or more contiguous amino acids from PSCA, variants, or analogs thereof.

A. In vitro transcription and translation constructs:

pCRII: To generate PSCA sense and anti-sense RNA probes for RNA in situ investigations, pCRII constructs (Invitrogen, Carlsbad Calif.) are generated encoding either all or fragments of the PSCA cDNA. The pCRII vector has Sp6 and T7 promoters flanking the insert to drive the transcription of PSCA RNA for use as probes in RNA in situ hybridization experiments. These probes are used to analyze the cell and tissue expression of PSCA at the RNA level. Transcribed PSCA RNA representing the cDNA amino acid coding region of the PSCA gene is used in in vitro translation systems such as the TnTTM Coupled Reticulolysate System (Promega, Corp., Madison, Wis.) to synthesize PSCA protein.

B. Bacterial Constructs:

pGEX Constructs: To generate recombinant PSCA proteins in bacteria that are fused to the Glutathione S-transferase (GST) protein, all or parts of the PSCA cDNA protein coding sequence are cloned into the pGEX family of GST-fusion vectors (Amersham Pharmacia Biotech, Piscataway, N.J.). These constructs allow controlled expression of recombinant PSCA protein sequences with GST fused at the amino-terminus and a six histidine epitope (6X His) at the carboxyl-terminus. The GST and 6X His tags permit purification of the recombinant fusion protein from induced bacteria with the appropriate affinity matrix and allow recognition of the fusion protein with anti-GST and anti-His antibodies. The 6X His tag is generated by adding 6 histidine codons to the cloning primer at the 3' end, e.g., of the open reading frame (ORF). A proteolytic cleavage site, such as the PreScission™ recognition site in pGEX-6P-1, may be employed such that it permits cleavage of the GST tag from PSCA-related protein. The ampicillin resistance gene and pBR322 origin permits selection and maintenance of the pGEX plasmids in E. coli.

pMAL Constructs: To generate, in bacteria, recombinant PSCA proteins that are fused to maltose-binding protein (MBP), all or parts of the PSCA cDNA protein coding sequence are fused to the MBP gene by cloning into the pMAL-c2X and pMAL-p2X vectors (New England Biolabs, Beverly, Mass.). These constructs allow controlled expression of recombinant PSCA protein sequences with MBP fused at the amino-terminus and a 6X His epitope tag at the carboxyl-terminus. The MBP and 6X His tags permit purification of the recombinant protein from induced bacteria with the appropriate affinity matrix and allow recognition of the fusion protein with anti-MBP and anti-His antibodies. The 6X His epitope tag is generated by adding 6 histidine codons to the 3' cloning primer. A Factor Xa recognition site permits cleavage of the pMAL tag from PSCA. The pMAL-c2X and pMAL-p2X vectors are optimized to express the recombinant protein in the cytoplasm or periplasm respectively. Periplasm expression enhances folding of proteins with disulfide bonds.

pET Constructs: To express PSCA in bacterial cells, all or parts of the PSCA cDNA protein coding sequence are cloned into the pET family of vectors (Novagen, Madison, Wis.). These vectors allow tightly controlled expression of recombinant PSCA protein in bacteria with and without fusion to proteins that enhance solubility, such as NusA and thioredoxin (Trx), and epitope tags, such as 6X His and S-Tag™ that aid purification and detection of the recombinant protein. For example, constructs are made utilizing pET NusA fusion system 43.1 such that regions of the PSCA protein are expressed as amino-terminal fusions to NusA.

C. Yeast Constructs:

pESC Constructs: To express PSCA in the yeast species *Saccharomyces cerevisiae* for generation of recombinant protein and functional studies, all or parts of the PSCA cDNA protein coding sequence are cloned into the pESC family of vectors each of which contain 1 of 4 selectable markers, HIS3, TRP1, LEU2, and URA3 (Stratagene, La Jolla, Calif.). These vectors allow controlled expression from the same plasmid of up to 2 different genes or cloned sequences containing either Flag™ or Myc epitope tags in the same yeast cell. This system is useful to confirm protein-protein interactions of PSCA. In addition, expression in yeast yields similar post-translational modifications, such as glycosylations and phosphorylations, that are found when expressed in eukaryotic cells.

pESP Constructs: To express PSCA in the yeast species *Saccharomyces pombe*, all or parts of the PSCA cDNA protein coding sequence are cloned into the pESP family of vectors. These vectors allow controlled high level of expression of a PSCA protein sequence that is fused at either the amino terminus or at the carboxyl terminus to GST which aids purification of the recombinant protein. A Flag™ epitope tag allows detection of the recombinant protein with anti-Flag™ antibody.

Example 8

Production of Recombinant PSCA in Higher Eukaryotic Systems

Intentionally Omitted

Example 9

Antigenicity Profiles and Secondary Structure

FIG. 5A-C, FIG. 6A-C, FIG. 7A-C, FIG. 8A-C, and FIG. 9A-C depict graphically five amino acid profiles of PSCA variants 1, 3, and 4, each assessment available by accessing the ProtScale website located on the World Wide Web at (expasy.ch/cgi-bin/protscale.pl) on the ExPasy molecular biology server.

These profiles: FIG. 5, Hydrophilicity, (Hopp T. P., Woods K. R., 1981. Proc. Natl. Acad. Sci. U.S.A. 78:3824-3828); FIG. 6, Hydropathicity, (Kyte J., Doolittle R. F., 1982. J. Mol. Biol. 157:105-132); FIG. 7, Percentage Accessible Residues (Janin J., 1979 Nature 277:491-492); FIG. 8, Average Flexibility, (Bhaskaran R., and Ponnuswamy P. K., 1988. Int. J. Pept. Protein Res. 32:242-255); FIG. 9, Beta-turn (Deleage, G., Roux B. 1987 Protein Engineering 1:289-294); and optionally others available in the art, such as on the ProtScale website, were used to identify antigenic regions of each of the PSCA variant proteins. Each of the above amino acid profiles of PSCA variants were generated using the following ProtScale parameters for analysis: 1) A window size of 9; 2) 100% weight of the window edges compared to the window center; and, 3) amino acid profile values normalized to lie between 0 and 1.

Hydrophilicity (FIG. 5), Hydropathicity (FIG. 6) and Percentage Accessible Residues (FIG. 7) profiles were used to determine stretches of hydrophilic amino acids (i.e., values greater than 0.5 on the Hydrophilicity and Percentage Accessible Residues profile, and values less than 0.5 on the Hydropathicity profile). Such regions are likely to be exposed to the aqueous environment, be present on the surface of the protein, and thus available for immune recognition, such as by antibodies.

Average Flexibility (FIG. 8) and Beta-turn (FIG. 9) profiles determine stretches of amino acids (i.e., values greater than 0.5 on the Beta-turn profile and the Average Flexibility profile) that are not constrained in secondary structures such as beta sheets and alpha helices. Such regions are also more likely to be exposed on the protein and thus accessible to immune recognition, such as by antibodies.

Antigenic sequences of the PSCA variant proteins indicated, e.g., by the profiles set forth in FIG. 5A-C, FIG. 6A-C, FIG. 7A-C, FIG. 8A-C, and/or FIG. 9A-C are used to prepare immunogens, either peptides or nucleic acids that encode them, to generate therapeutic and diagnostic anti-PSCA antibodies. The immunogen can be any 5, 6, 7, 8, 9, 10, 11, 12, 13, 14, 15, 16, 17, 18, 19, 20, 21, 22, 23, 24, 25, 30, 35, 40, 45, 50 or more than 50 contiguous amino acids, or the corresponding nucleic acids that encode them, from the PSCA protein variants listed in FIGS. 2 and 3 of which the amino acid profiles are shown in FIG. 9, or can be inferred because the variant contains sequence that is the same as a variant depicted in FIG. 9. In particular, peptide immunogens of the invention can comprise, a peptide region of at least 5 amino acids of FIGS. 2 and 3 in any whole number increment that includes an amino acid position having a value greater than 0.5 in the Hydrophilicity profiles of FIG. 5; a peptide region of at least 5 amino acids of FIGS. 2 and 3 in any whole number increment that includes an amino acid position having a value less than 0.5 in the Hydropathicity profile of FIG. 6; a peptide region of at least 5 amino acids of FIGS. 2 and 3 in any whole number increment that includes an amino acid position having a value greater than 0.5 in the Percent Accessible Residues profiles of FIG. 7; a peptide region of at least 5 amino acids of FIGS. 2 and 3 in any whole number increment that includes an amino acid position having a value greater than 0.5 in the Average Flexibility profiles on FIG. 8; and, a peptide region of at least 5 amino acids of FIGS. 2 and 3 in any whole number increment that includes an amino acid position having a value greater than 0.5 in the Beta-turn profile of FIG. 9. Peptide immunogens of the invention can also comprise nucleic acids that encode any of the forgoing.

All immunogens of the invention, peptide or nucleic acid, can be embodied in human unit dose form, or comprised by a composition that includes a pharmaceutical excipient compatible with human physiology.

The secondary structure of PSCA protein variants 1, 3, 4, and 6, namely the predicted presence and location of alpha helices, extended strands, and random coils, is predicted from the primary amino acid sequence using the HNN—Hierarchical Neural Network method (NPS @: Network Protein Sequence Analysis TIBS 2000 March Vol. 25, No 3 [291]: 147-150 Combet C., Blanchet C., Geourjon C. and Deléage G., located on the World Wide Web at pbil.ibcp.fr/cgi-bin/npsa_automat.pl?page=npsa_nn.html), accessed from the ExPasy molecular biology server located on the World Wide Web at (expasy.ch/tools/). The analysis indicates that PSCA variant 1 is composed of 30.89% alpha helix, 21.95% extended strand, and 47.15% random coil (FIG. 13A). PSCA protein variant 3 is composed of 14.89% alpha helix, 8.51% extended strand, and 76.60% random coil (FIG. 13B). PSCA protein variant 4 is composed of 9.52% alpha helix, 8.99% extended strand, and 81.48% random coil (FIG. 13C). PSCA protein variant 6 is composed of 24.56% alpha helix, 21.93% extended strand, and 53.51% random coil (FIG. 13D).

Analysis for the potential presence of transmembrane domains in the PSCA variant proteins was carried out using a variety of transmembrane prediction algorithms accessed from the ExPasy molecular biology server located on the World Wide Web at (expasy.ch/tools/). Shown graphically in FIG. 13E, G, I, and K are the results of analyses of variants 1, 3, 4, and 6, respectively, using the TMpred program. Shown graphically in FIGS. 13F, H, J, and L are the results of analyses of variants 1, 3, 4, and 6, respectively using the TMHMM program. PSCA variant 1 and variant 6 proteins are likely to encode GPI-linked proteins. Variants 3 and 4 are likely to encode soluble proteins since they do not contain significant predictions for transmembrane domains. The results of structural analysis programs are summarized in Table VI.

Example 10

Generation of PSCA Polyclonal Antibodies

Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. In addition to immunizing with a full length PSCA protein variant, computer algorithms are employed in design of immunogens that, based on amino acid sequence analysis contain characteristics of being antigenic and available for recognition by the immune system of the immunized host (see the Example entitled "Antigenicity Profiles and Secondary Structure"). Such regions would be predicted to be hydrophilic, flexible, in beta-turn conformations, and be exposed on the surface of the protein (see, e.g., FIG. 5A-C, FIG. 6A-C, FIG. 7A-C, FIG. 8A-C, or FIG. 9A-C for amino acid profiles that indicate such regions of PSCA protein variant 1).

For example, recombinant bacterial fusion proteins or peptides containing hydrophilic, flexible, beta-turn regions of PSCA protein variants are used as antigens to generate polyclonal antibodies in New Zealand White rabbits or monoclonal antibodies as described in Example 11. For example, in PSCA variant 1, such regions include, but are not limited to, amino acids 28-56 and amino acids 66-94. For variant 3, such regions include, but are not limited to, amino acids 7-39 and amino acids 70-94. For variant 4 such regions include, but are not limited to, amino acids 6-18, amino acids 27-39, amino acids 103-133, and 177-189. For variant 6, such regions include, but are not limited to, amino acids 19-35 and amino acids 57-85. It is useful to conjugate the immunizing agent to a protein known to be immunogenic in the mammal being immunized. Examples of such immunogenic proteins include, but are not limited to, keyhole limpet hemocyanin (KLH), serum albumin, bovine thyroglobulin, and soybean trypsin inhibitor. In one embodiment, a peptide encoding amino acids 103-133 of PSCA variant 4 is conjugated to KLH and used to immunize a rabbit. Alternatively the immunizing agent may include all or portions of the PSCA variant proteins, analogs or fusion proteins thereof. For example, the PSCA variants amino acid sequences can be fused using recombinant DNA techniques to any one of a variety of fusion protein partners that are well known in the art, such as glutathione-S-transferase (GST) and HIS tagged fusion proteins. In one embodiment, the PSCA variant 1 sequence, amino acids 18-98 was fused to GST using recombinant techniques in the pGEX expression vector, expressed, purified and used to immunize both rabbits and mice to generate polyclonal and monoclonal antibodies respectively. Such fusion proteins are purified from induced bacteria using the appropriate affinity matrix.

Other recombinant bacterial fusion proteins that may be employed include maltose binding protein, LacZ, thioredoxin, NusA, or an immunoglobulin constant region (see the section entitled "Production of PSCA in Prokaryotic Systems" and Current Protocols In Molecular Biology, Volume 2, Unit 16, Frederick M. Ausubul et al. eds., 1995; Linsley, P. S., Brady, W., Urnes, M., Grosmaire, L., Damle, N., and Ledbetter, L.(1991) J.Exp. Med. 174, 561-566).

In addition to bacterial derived fusion proteins, mammalian expressed protein antigens are also used. These antigens are expressed from mammalian expression vectors such as the Tag5 and Fc-fusion vectors (see the section entitled "Production of Recombinant PSCA in Eukaryotic Systems"), and retain post-translational modifications such as glycosylations found in native protein. In one embodiment, the cDNA of PSCA variant 1, minus the N-terminal leader peptide and C-terminal GPI anchor was cloned into the Tag5 mammalian secretion vector, and expressed in 293T cells. The recombinant protein was purified by metal chelate chromatography from tissue culture supernatants of 293T cells stably expressing the recombinant vector. The purified Tag5 PSCA protein was then used as immunogen.

During the immunization protocol, it is useful to mix or emulsify the antigen in adjuvants that enhance the immune response of the host animal. Examples of adjuvants include, but are not limited to, complete Freund's adjuvant (CFA) and MPL-TDM adjuvant (monophosphoryl Lipid A, synthetic trehalose dicorynomycolate).

In a typical protocol, rabbits are initially immunized subcutaneously with up to 200 µg, typically 100-200 µg, of fusion protein or peptide conjugated to KLH mixed in complete Freund's adjuvant (CFA). Rabbits are then injected subcutaneously every two weeks with up to 200 µg, typically 100-200 µg, of the immunogen in incomplete Freund's adjuvant (IFA). Test bleeds are taken approximately 7-10 days following each immunization and used to monitor the titer of the antiserum by ELISA.

To test reactivity and specificity of immune serum, such as rabbit serum derived from immunization with a GST-fusion of PSCA variant 3 or 4 protein, the respective full-length PSCA variant cDNA is cloned into pCDNA 3.1 myc-his expression vector (Invitrogen, see the Example entitled "Production of Recombinant PSCA in Eukaryotic Systems"). After transfection of the constructs into 293T cells, cell lysates are probed with the anti-variant serum and with anti-His antibody (Santa Cruz Biotechnologies, Santa Cruz, Calif.) to determine specific reactivity to denatured variant protein using the Western blot technique. In addition, the immune serum is tested by fluorescence microscopy, flow cytometry and immunoprecipitation against 293T and other recombinant PSCA variant-expressing cells to determine specific recognition of native protein. Western blot, immunoprecipitation, fluorescent microscopy, and flow cytometric techniques using cells that endogenously express PSCA are also carried out to test reactivity and specificity.

Anti-serum from rabbits immunized with PSCA variant fusion proteins, such as GST and MBP fusion proteins, are purified by depletion of antibodies reactive to the fusion partner sequence by passage over an affinity column containing the fusion partner either alone or in the context of an irrelevant fusion protein. For example, antiserum derived from a GST-PSCA variant 1 fusion protein is first purified by passage over a column of GST protein covalently coupled to AffiGel matrix (BioRad, Hercules, Calif.). The antiserum is then affinity purified by passage over a column composed of a MBP-PSCA fusion protein covalently coupled to Affigel matrix. The serum is then further purified by protein G affinity chromatography to isolate the IgG fraction. Sera from other His-tagged antigens and peptide immunized rabbits as well as fusion partner depleted sera are affinity purified by passage over a column matrix composed of the original protein immunogen or free peptide.

Example 11

Generation of PSCA Monoclonal Antibodies (mAbs)

In one embodiment, therapeutic mAbs to PSCA variants comprise those that react with epitopes specific for each variant protein or specific to sequences in common between the variants that would disrupt or modulate the biological function of the PSCA variants, for example those that would disrupt the interaction with ligands and binding partners. Immunogens for generation of such mAbs include those designed to encode or contain the entire PSCA protein variant sequence, regions of the PSCA protein variants predicted to be antigenic from computer analysis of the amino acid sequence (see, e.g., FIG. 5A-C, FIG. 6A-C, FIG. 7A-C, FIG. 8A-C, or FIG. 9A-C, and the Example entitled "Antigenicity Profiles"). Immunogens include peptides, recombinant bacterial proteins, and mammalian expressed Tag5 proteins and human and murine IgG FC fusion proteins. In addition, cells engineered to express high levels of a respective PSCA variant, such as 293T-PSCA variant 4 or 300.19-PSCA variant 4 murine Pre-B cells, are used to immunize mice.

To generate mAbs to a PSCA variant, mice are first immunized intraperitoneally (IP) with, typically, 10-50 µg of protein immunogen or $10^7$ PSCA-expressing cells mixed in complete Freund's adjuvant. Mice are then subsequently immunized IP every 2-4 weeks with, typically, 10-50 µg of protein immunogen or $10^7$ cells mixed in incomplete Freund's adjuvant. Alternatively, MPL-TDM adjuvant is used in immunizations. In addition to the above protein and cell-based immunization strategies, a DNA-based immunization protocol is employed in which a mammalian expression vector encoding a PSCA variant sequence is used to immunize mice by direct injection of the plasmid DNA. For example, the complete cDNA of PSCA of variant 4 is cloned into the Tag5 mammalian secretion vector and the recombinant vector will then be used as immunogen. In another example the same amino acids are cloned into an Fc-fusion secretion vector in which the PSCA variant 4 sequence is fused at the amino-terminus to an IgK leader sequence and at the carboxyl-terminus to the coding sequence of the human or murine IgG Fc region. This recombinant vector is then used as immunogen. The plasmid immunization protocols are used in combination with purified proteins expressed from the same vector and with cells expressing the respective PSCA variant.

During the immunization protocol, test bleeds are taken 7-10 days following an injection to monitor titer and specificity of the immune response. Once appropriate reactivity and specificity is obtained as determined by ELISA, Western blotting, immunoprecipitation, fluorescence microscopy, and flow cytometric analyses, fusion and hybridoma generation is then carried out with established procedures well known in the art (see, e.g., Harlow and Lane, 1988).

In one embodiment for generating PSCA monoclonal antibodies, a GST-fusion of variant 4 antigen encoding amino acids 1-189 is expressed and then purified from stably transfected 293T cells. Balb C mice are initially immunized intraperitoneally with 25 µg of the GST-PSCA variant 4 protein mixed in complete Freund's adjuvant. Mice are subsequently immunized every two weeks with 25 µg of the antigen mixed in incomplete Freund's adjuvant for a total of three immunizations. ELISA using the GST-fusion antigen and a cleavage product from which the GST portion is removed determines the titer of serum from immunized mice. Reactivity and specificity of serum to full length PSCA variant 4 protein is monitored by Western blotting, immunoprecipitation and flow cytometry using 293T cells transfected with an expression vector encoding the PSCA variant 1 cDNA (see e.g., the Example entitled "Production of Recombinant PSCA in Eukaryotic Systems"). Other recombinant PSCA variant 4-expressing cells or cells endogenously expressing PSCA variant 4 are also used. Mice showing the strongest reactivity are rested and given a final injection of Tag5 antigen in PBS and then sacrificed four days later. The spleens of the sacrificed mice are harvested and fused to SPO/2 myeloma cells using standard procedures (Harlow and Lane, 1988). Supernatants from HAT selected growth wells are screened by ELISA, Western blot, immunoprecipitation, fluorescent microscopy, and flow cytometry to identify PSCA specific antibody-producing clones.

To generate monoclonal antibodies that are specific for PSCA variant 4 protein, immunogens are designed to encode the sequence unique to that variant. For example, a peptide encoding amino acids 6-18 of PSCA variant 4 is synthesized, conjugated to KLH and used as immunogen. Hybridoma supernatants are then screened on the peptide antigen and then further screened on cells expressing the PSCA variant 4 protein and cross-screened on cells expressing the other PSCA variants to derive variant 4-specific monoclonal antibodies.

The binding affinity of a PSCA variant monoclonal antibody is determined using standard technologies. Affinity measurements quantify the strength of antibody to epitope binding and are used to help define which PSCA variant monoclonal antibodies preferred for diagnostic or therapeutic use, as appreciated by one of skill in the art. The BIAcore system (Uppsala, Sweden) is a preferred method for determining binding affinity. The BIAcore system uses surface plasmon resonance (SPR, Welford K. 1991, Opt. Quant. Elect. 23:1; Morton and Myszka, 1998, Methods in Enzymology 295: 268) to monitor biomolecular interactions in real time. BIAcore analysis conveniently generates association rate constants, dissociation rate constants, equilibrium dissociation constants, and affinity constants.

Example 12

HLA Class I and Class II Binding Assays

HLA class I and class II binding assays using purified HLA molecules are performed in accordance with disclosed protocols (e.g., PCT publications WO 94/20127 and WO 94/03205; Sidney et al., *Current Protocols in Immunology* 18.3.1 (1998); Sidney, et al., *J. Immunol.* 154:247 (1995); Sette, et al., *Mol. Immunol.* 31:813 (1994)). Briefly, purified MHC molecules (5 to 500 nM) are incubated with various unlabeled peptide inhibitors and 1-10 nM $^{125}$I-radiolabeled probe peptides as described. Following incubation, MHC-peptide complexes are separated from free peptide by gel filtration and the fraction of peptide bound is determined. Typically, in preliminary experiments, each MHC preparation is titered in the presence of fixed amounts of radiolabeled peptides to determine the concentration of HLA molecules necessary to bind 10-20% of the total radioactivity. All subsequent inhibition and direct binding assays are performed using these HLA concentrations.

Since under these conditions [label]<[HLA] and $IC_{50} \geqq$ [HLA], the measured $IC_{50}$ values are reasonable approximations of the true $K_D$ values. Peptide inhibitors are typically tested at concentrations ranging from 120 μg/ml to 1.2 ng/ml, and are tested in two to four completely independent experiments. To allow comparison of the data obtained in different experiments, a relative binding figure is calculated for each peptide by dividing the $IC_{50}$ of a positive control for inhibition by the $IC_{50}$ for each tested peptide (typically unlabeled versions of the radiolabeled probe peptide). For database purposes, and inter-experiment comparisons, relative binding values are compiled. These values can subsequently be converted back into $IC_{50}$ nM values by dividing the $IC_{50}$ nM of the positive controls for inhibition by the relative binding of the peptide of interest. This method of data compilation is accurate and consistent for comparing peptides that have been tested on different days, or with different lots of purified MHC.

Binding assays as outlined above may be used to analyze HLA supermotif and/or HLA motif-bearing peptides (see Table IV).

Example 13

Identification of HLA Supermotif- and Motif-Bearing CTL Candidate Epitopes

HLA vaccine compositions of the invention can include multiple epitopes. The multiple epitopes can comprise multiple HLA supermotifs or motifs to achieve broad population coverage. This example illustrates the identification and confirmation of supermotif- and motif-bearing epitopes for the inclusion in such a vaccine composition. Calculation of population coverage is performed using the strategy described below.

Computer searches and algorithms for identification of supermotif and/or motif-bearing epitopes The searches performed to identify the motif-bearing peptide sequences in the Example entitled "Antigenicity Profiles" and Tables VIII-XXI and XXII-XLIX employ the protein sequence data from the gene product of PSCA set forth in FIGS. 2 and 3, the specific search peptides used to generate the tables are listed in Table VII.

Computer searches for epitopes bearing HLA Class I or Class II supermotifs or motifs are performed as follows. All translated PSCA protein sequences are analyzed using a text string search software program to identify potential peptide sequences containing appropriate HLA binding motifs; such programs are readily produced in accordance with information in the art in view of known motif/supermotif disclosures. Furthermore, such calculations can be made mentally.

Identified A2-, A3-, and DR-supermotif sequences are scored using polynomial algorithms to predict their capacity to bind to specific HLA-Class I or Class II molecules. These polynomial algorithms account for the impact of different amino acids at different positions, and are essentially based on the premise that the overall affinity (or ΔG) of peptide-HLA molecule interactions can be approximated as a linear polynomial function of the type:

$$\text{“}\Delta G\text{”} = a_{1i} \times a_{2i} \times a_{3i} \ldots \times a_{ni}$$

where $a_{ji}$ is a coefficient which represents the effect of the presence of a given amino acid (j) at a given position (i) along the sequence of a peptide of n amino acids. The crucial assumption of this method is that the effects at each position are essentially independent of each other (i.e., independent binding of individual side-chains When residue j occurs at position i in the peptide, it is assumed to contribute a constant amount $j_i$ to the free energy of binding of the peptide irrespective of the sequence of the rest of the peptide.

The method of derivation of specific algorithm coefficients has been described in Gulukota et al., *J. Mol. Biol.* 267:1258-126, 1997; (see also Sidney et al., *Human Immunol.* 45:79-93, 1996; and Southwood et al., *J. Immunol.* 160:3363-3373, 1998). Briefly, for all i positions, anchor and non-anchor alike, the geometric mean of the average relative binding (ARB) of all peptides carrying j is calculated relative to the remainder of the group, and used as the estimate of $j_i$. For Class II peptides, if multiple alignments are possible, only the highest scoring alignment is utilized, following an iterative procedure. To calculate an algorithm score of a given peptide in a test set, the ARB values corresponding to the sequence of the peptide are multiplied. If this product exceeds a chosen threshold, the peptide is predicted to bind. Appropriate thresholds are chosen as a function of the degree of stringency of prediction desired.

Selection of HLA-A2 supertype cross-reactive peptides

Protein sequences from PSCA are scanned utilizing motif identification software, to identify 8-, 9- 10- and 11-mer sequences containing the HLA-A2-supermotif main anchor specificity. Typically, these sequences are then scored using the protocol described above and the peptides corresponding to the positive-scoring sequences are synthesized and tested for their capacity to bind purified HLA-A*0201 molecules in vitro (HLA-A*0201 is considered a prototype A2 supertype molecule).

These peptides are then tested for the capacity to bind to additional A2-supertype molecules (A*0202, A*0203, A*0206, and A*6802). Peptides that bind to at least three of the five A2-supertype alleles tested are typically deemed A2-supertype cross-reactive binders. Preferred peptides bind at an affinity equal to or less than 500 nM to three or more HLA-A2 supertype molecules.

Selection of HLA-A3 supermotif-bearing epitopes

The PSCA protein sequence(s) scanned above is also examined for the presence of peptides with the HLA-A3-supermotif primary anchors. Peptides corresponding to the HLA A3 supermotif-bearing sequences are then synthesized and tested for binding to HLA-A*0301 and HLA-A*1101 molecules, the molecules encoded by the two most prevalent A3-supertype alleles. The peptides that bind at least one of the two alleles with binding affinities of ≦500 nM, often ≦200 nM, are then tested for binding cross-reactivity to the other common A3-supertype alleles (e.g., A*3101, A*3301, and A*6801) to identify those that can bind at least three of the five HLA-A3-supertype molecules tested.

Selection of HLA-B7 supermotif bearing epitopes

The PSCA protein(s) scanned above is also analyzed for the presence of 8-, 9- 10-, or 11-mer peptides with the HLA-B7-supermotif. Corresponding peptides are synthesized and tested for binding to HLA-B*0702, the molecule encoded by the most common B7-supertype allele (i.e., the prototype B7 supertype allele). Peptides binding B*0702 with $IC_{50}$ of ≦500 nM are identified using standard methods. These peptides are then tested for binding to other common B7-supertype molecules (e.g., B*3501, B*5101, B*5301, and B*5401). Peptides capable of binding to three or more of the five B7-supertype alleles tested are thereby identified.

Selection of A1 and A24 motif-bearing epitopes

To further increase population coverage, HLA-A1 and -A24 epitopes can also be incorporated into vaccine compositions. An analysis of the PSCA protein can also be performed to identify HLA-A1- and A24-motif-containing sequences.

High affinity and/or cross-reactive binding epitopes that bear other motif and/or supermotifs are identified using analogous methodology.

Example 14

Confirmation of Immunogenicity

Cross-reactive candidate CTL A2-supermotif-bearing peptides that are identified as described herein are selected to confirm in vitro immunogenicity. Confirmation is performed using the following methodology:

Target Cell Lines for Cellular Screening:

The .221A2.1 cell line, produced by transferring the HLA-A2.1 gene into the HLA-A, -B, -C null mutant human B-lymphoblastoid cell line 721.221, is used as the peptide-loaded target to measure activity of HLA-A2.1-restricted CTL. This cell line is grown in RPMI-1640 medium supplemented with antibiotics, sodium pyruvate, nonessential amino acids and 10% (v/v) heat inactivated FCS. Cells that express an antigen of interest, or transfectants comprising the gene encoding the antigen of interest, can be used as target cells to confirm the ability of peptide-specific CTLs to recognize endogenous antigen.

Primary CTL Induction Cultures:

Generation of Dendritic Cells (DC): PBMCs are thawed in RPMI with 30 μg/ml DNAse, washed twice and resuspended in complete medium (RPMI-1640 plus 5% AB human serum, non-essential amino acids, sodium pyruvate, L-glutamine and penicillin/streptomycin). The monocytes are purified by plating $10 \times 10^6$ PBMC/well in a 6-well plate. After 2 hours at 37° C., the non-adherent cells are removed by gently shaking the plates and aspirating the supernatants. The wells are washed a total of three times with 3 ml RPMI to remove most of the non-adherent and loosely adherent cells. Three ml of complete medium containing 50 ng/ml of GM-CSF and 1,000 U/ml of IL-4 are then added to each well. TNFα is added to the DCs on day 6 at 75 ng/ml and the cells are used for CTL induction cultures on day 7.

Induction of CTL with DC and Peptide: CD8+ T-cells are isolated by positive selection with Dynal immunomagnetic beads (Dynabeads® M-450) and the detacha-bead® reagent. Typically about $200\text{-}250 \times 10^6$ PBMC are processed to obtain $24 \times 10^6$ CD8$^+$ T-cells (enough for a 48-well plate culture). Briefly, the PBMCs are thawed in RPMI with 30 μg/ml DNAse, washed once with PBS containing 1% human AB serum and resuspended in PBS/1% AB serum at a concentration of $20 \times 10^6$ cells/ml. The magnetic beads are washed 3 times with PBS/AB serum, added to the cells (140 μl beads/$20 \times 10^6$ cells) and incubated for 1 hour at 4° C. with continuous mixing. The beads and cells are washed 4× with PBS/AB serum to remove the nonadherent cells and resuspended at $100 \times 10^6$ cells/ml (based on the original cell number) in PBS/AB serum containing 100 μl/ml detacha-bead® reagent and 30 μg/ml DNAse. The mixture is incubated for 1 hour at room temperature with continuous mixing. The beads are washed again with PBS/AB/DNAse to collect the CD8+ T-cells. The DC are collected and centrifuged at 1300 rpm for 5-7 minutes, washed once with PBS with 1% BSA, counted and pulsed with 40 μg/ml of peptide at a cell concentration of $1\text{-}2 \times 10^6$/ml in the presence of 3 μg/ml $\beta_2$-microglobulin for 4 hours at 20° C. The DC are then irradiated (4,200 rads), washed 1 time with medium and counted again.

Setting up induction cultures: 0.25 ml cytokine-generated DC (at $1 \times 10^5$ cells/ml) are co-cultured with 0.25 ml of CD8+ T-cells (at $2 \times 10^6$ cell/ml) in each well of a 48-well plate in the presence of 10 ng/ml of IL-7. Recombinant human IL-10 is added the next day at a final concentration of 10 ng/ml and rhuman IL-2 is added 48 hours later at 10 IU/ml.

Restimulation of the induction cultures with peptide-pulsed adherent cells: Seven and fourteen days after the primary induction, the cells are restimulated with peptide-pulsed adherent cells. The PBMCs are thawed and washed twice with RPMI and DNAse. The cells are resuspended at $5 \times 10^6$ cells/ml and irradiated at ~4200 rads. The PBMCs are plated at $2 \times 10^6$ in 0.5 ml complete medium per well and incubated for 2 hours at 37° C. The plates are washed twice with RPMI by tapping the plate gently to remove the nonadherent cells and the adherent cells pulsed with 10 μg/ml of peptide in the presence of 3 μg/ml β2 microglobulin in 0.25 ml RPMI/5% AB per well for 2 hours at 37° C. Peptide solution from each well is aspirated and the wells are washed once with RPMI. Most of the media is aspirated from the induction cultures (CD8+ cells) and brought to 0.5 ml with fresh media. The cells are then transferred to the wells containing the peptide-pulsed adherent cells. Twenty four hours later recombinant human IL-10 is added at a final concentration of 10 ng/ml and recombinant human IL2 is added the next day and again 2-3 days later at 50 IU/ml (Tsai et al., *Critical Reviews in Immunology* 18(1-2):65-75, 1998). Seven days later, the cultures are assayed for CTL activity in a $^{51}$Cr release assay. In some experiments the cultures are assayed for peptide-specific recognition in the in situ IFNγ ELISA at the time of the second restimulation followed by assay of endogenous recognition 7 days later. After expansion, activity is measured in both assays for a side-by-side comparison.

Measurement of CTL lytic activity by $^{51}$Cr release.

Seven days after the second restimulation, cytotoxicity is determined in a standard (5 hr) $^{51}$Cr release assay by assaying individual wells at a single E:T. Peptide-pulsed targets are prepared by incubating the cells with 10 μg/ml peptide overnight at 37° C.

Adherent target cells are removed from culture flasks with trypsin-EDTA. Target cells are labeled with 200 μCi of $^{51}$Cr sodium chromate (Dupont, Wilmington, Del.) for 1 hour at 37° C. Labeled target cells are resuspended at $10^6$ per ml and diluted 1:10 with K562 cells at a concentration of $3.3 \times 10^6$/ml (an NK-sensitive erythroblastoma cell line used to reduce non-specific lysis). Target cells (100 μl) and effectors (100 μl) are plated in 96 well round-bottom plates and incubated for 5 hours at 37° C. At that time, 100 μl of supernatant are collected from each well and percent lysis is determined according to the formula:

[(cpm of the test sample–cpm of the spontaneous$^{51}$Cr release sample)/(cpm of the maximal$^{51}$Cr release sample–cpm of the spontaneous$^{51}$Cr release sample)]×100.

Maximum and spontaneous release are determined by incubating the labeled targets with 1% Triton X-100 and media alone, respectively. A positive culture is defined as one in which the specific lysis (sample-background) is 10% or higher in the case of individual wells and is 15% or more at the two highest E:T ratios when expanded cultures are assayed.

In situ Measurement of Human IFNγ Production as an Indicator of Peptide-specific and Endogenous Recognition Immulon 2 plates are coated with mouse anti-human IFNγ monoclonal antibody (4 μg/ml 0.1 M NaHCO$_3$, pH8.2) overnight at 4° C. The plates are washed with Ca$^{2+}$, Mg$^{2+}$-free PBS/0.05% Tween 20 and blocked with PBS/10% FCS for two hours, after which the CTLs (100 μl/well) and targets (100 μl/well) are added to each well, leaving empty wells for the standards and blanks (which received media only). The target cells, either peptide-pulsed or endogenous targets, are used at a concentration of $1 \times 10^6$ cells/ml. The plates are incubated for 48 hours at 37° C. with 5% CO$_2$.

Recombinant human IFN-gamma is added to the standard wells starting at 400 pg or 1200 pg/100 microliter/well and the plate incubated for two hours at 37° C. The plates are washed and 100 μl of biotinylated mouse anti-human IFN-gamma monoclonal antibody (2 microgram/ml in PBS/3% FCS/0.05% Tween 20) are added and incubated for 2 hours at room temperature. After washing again, 100 microliter HRP-streptavidin (1:4000) are added and the plates incubated for one hour at room temperature. The plates are then washed 6× with wash buffer, 100 microliter/well developing solution (TMB 1:1) are added, and the plates allowed to develop for 5-15 minutes. The reaction is stopped with 50 microliter/well 1 M H$_3$PO$_4$ and read at OD450. A culture is considered positive if it measured at least 50 pg of IFN-gamma/well above background and is twice the background level of expression.

CTL Expansion.

Those cultures that demonstrate specific lytic activity against peptide-pulsed targets and/or tumor targets are expanded over a two week period with anti-CD3. Briefly, $5 \times 10^4$ CD8+ cells are added to a T25 flask containing the following: $1 \times 10^6$ irradiated (4,200 rad) PBMC (autologous or allogeneic) per ml, $2 \times 10^5$ irradiated (8,000 rad) EBV—transformed cells per ml, and OKT3 (anti-CD3) at 30 ng per ml in RPMI-1640 containing 10% (v/v) human AB serum, non-essential amino acids, sodium pyruvate, 25 μM 2-mercaptoethanol, L-glutamine and penicillin/streptomycin. Recombinant human IL2 is added 24 hours later at a final concentration of 200 IU/ml and every three days thereafter with fresh media at 50 IU/ml. The cells are split if the cell concentration exceeds $1 \times 10^6$/ml and the cultures are assayed between days 13 and 15 at E:T ratios of 30, 10, 3 and 1:1 in the $^{51}$Cr release assay or at $1 \times 10^6$/ml in the in situ IFNγ assay using the same targets as before the expansion.

Cultures are expanded in the absence of anti-CD3+ as follows. Those cultures that demonstrate specific lytic activity against peptide and endogenous targets are selected and $5 \times 10^4$ CD8+ cells are added to a T25 flask containing the following: $1 \times 10^6$ autologous PBMC per ml which have been peptide-pulsed with 10 μg/ml peptide for two hours at 37° C. and irradiated (4,200 rad); $2 \times 10^5$ irradiated (8,000 rad) EBV-transformed cells per ml RPMI-1640 containing 10% (v/v) human AB serum, non-essential AA, sodium pyruvate, 25 mM 2-ME, L-glutamine and gentamicin.

Immunogenicity of A2 supermotif-bearing peptides

A2-supermotif cross-reactive binding peptides are tested in the cellular assay for the ability to induce peptide-specific CTL in normal individuals. In this analysis, a peptide is typically considered to be an epitope if it induces peptide-specific CTLs in at least individuals, and preferably, also recognizes the endogenously expressed peptide.

Immunogenicity can also be confirmed using PBMCs isolated from patients bearing a tumor that expresses PSCA. Briefly, PBMCs are isolated from patients, re-stimulated with peptide-pulsed monocytes and assayed for the ability to recognize peptide-pulsed target cells as well as transfected cells endogenously expressing the antigen.

Evaluation of A*03/A11 immunogenicity

HLA-A3 supermotif-bearing cross-reactive binding peptides are also evaluated for immunogenicity using methodology analogous for that used to evaluate the immunogenicity of the HLA-A2 supermotif peptides.

Evaluation of B7 immunogenicity

Immunogenicity screening of the B7-supertype cross-reactive binding peptides identified as set forth herein are confirmed in a manner analogous to the confirmation of A2-and A3-supermotif-bearing peptides.

Peptides bearing other supermotifs/motifs, e.g., HLA-A1, HLA-A24 etc. are also confirmed using similar methodology.

Example 15

Implementation of the Extended Supermotif to Improve the Binding Capacity of Native Epitopes by Creating Analogs HLA motifs and supermotifs (comprising primary and/or secondary residues) are useful in the identification and preparation of highly cross-reactive native peptides, as demonstrated herein. Moreover, the definition of HLA motifs and supermotifs also allows one to engineer highly cross-reactive epitopes by identifying residues within a native peptide sequence which can be analoged to confer upon the peptide certain characteristics, e.g. greater cross-reactivity within the group of HLA molecules that comprise a supertype, and/or greater binding affinity for some or all of those HLA molecules. Examples of analoging peptides to exhibit modulated binding affinity are set forth in this example.

Analoging at Primary Anchor Residues

Peptide engineering strategies are implemented to further increase the cross-reactivity of the epitopes. For example, the main anchors of A2-supermotif-bearing peptides are altered, for example, to introduce a preferred L, I, V, or M at position 2, and I or V at the C-terminus.

To analyze the cross-reactivity of the analog peptides, each engineered analog is initially tested for binding to the prototype A2 supertype allele A*0201, then, if A*0201 binding capacity is maintained, for A2-supertype cross-reactivity.

Alternatively, a peptide is confirmed as binding one or all supertype members and then analoged to modulate binding affinity to any one (or more) of the supertype members to add population coverage.

The selection of analogs for immunogenicity in a cellular screening analysis is typically further restricted by the capacity of the parent wild type (WT) peptide to bind at least weakly, i.e., bind at an $IC_{50}$ of 5000 nM or less, to three of more A2 supertype alleles. The rationale for this requirement is that the WT peptides must be present endogenously in sufficient quantity to be biologically relevant. Analoged peptides have been shown to have increased immunogenicity and cross-reactivity by T cells specific for the parent epitope (see, e.g., Parkhurst et al., *J. Immunol.* 157:2539, 1996; and Pogue et al., *Proc. Natl. Acad. Sci. USA* 92:8166, 1995).

In the cellular screening of these peptide analogs, it is important to confirm that analog-specific CTLs are also able to recognize the wild-type peptide and, when possible, target cells that endogenously express the epitope.

Analoging of HLA-A3 and B7-supermotif-bearing peptides

Analogs of HLA-A3 supermotif-bearing epitopes are generated using strategies similar to those employed in analoging HLA-A2 supermotif-bearing peptides. For example, peptides binding to ⅗ of the A3-supertype molecules are engineered at primary anchor residues to possess a preferred residue (V, S, M, or A) at position 2.

The analog peptides are then tested for the ability to bind A*03 and A*11 (prototype A3 supertype alleles). Those peptides that demonstrate ≦500 nM binding capacity are then confirmed as having A3-supertype cross-reactivity.

Similarly to the A2- and A3-motif bearing peptides, peptides binding 3 or more B7-supertype alleles can be improved, where possible, to achieve increased cross-reactive binding or greater binding affinity or binding half life. B7 supermotif-bearing peptides are, for example, engineered to possess a preferred residue (V, I, L, or F) at the C-terminal primary anchor position, as demonstrated by Sidney et al. (*J. Immunol.* 157:3480-3490, 1996).

Analoging at primary anchor residues of other motif and/or supermotif-bearing epitopes is performed in a like manner.

The analog peptides are then be confirmed for immunogenicity, typically in a cellular screening assay. Again, it is generally important to demonstrate that analog-specific CTLs are also able to recognize the wild-type peptide and, when possible, targets that endogenously express the epitope.

Analoging at Secondary Anchor Residues

Moreover, HLA supermotifs are of value in engineering highly cross-reactive peptides and/or peptides that bind HLA molecules with increased affinity by identifying particular residues at secondary anchor positions that are associated with such properties. For example, the binding capacity of a B7 supermotif-bearing peptide with an F residue at position 1 is analyzed. The peptide is then analoged to, for example, substitute L for F at position 1. The analoged peptide is evaluated for increased binding affinity, binding half life and/ or increased cross-reactivity. Such a procedure identifies analoged peptides with enhanced properties.

Engineered analogs with sufficiently improved binding capacity or cross-reactivity can also be tested for immunogenicity in HLA-B7-transgenic mice, following for example, IFA immunization or lipopeptide immunization. Analoged peptides are additionally tested for the ability to stimulate a recall response using PBMC from patients with PSCA-expressing tumors.

Other analoging strategies

Another form of peptide analoging, unrelated to anchor positions, involves the substitution of a cysteine with α-amino butyric acid. Due to its chemical nature, cysteine has the propensity to form disulfide bridges and sufficiently alter the peptide structurally so as to reduce binding capacity. Substitution of α-amino butyric acid for cysteine not only alleviates this problem, but has been shown to improve binding and crossbinding capabilities in some instances (see, e.g., the review by Sette et al., In: Persistent Viral Infections, Eds. R. Ahmed and I. Chen, John Wiley & Sons, England, 1999).

Thus, by the use of single amino acid substitutions, the binding properties and/or cross-reactivity of peptide ligands for HLA supertype molecules can be modulated.

Example 16

Identification and Confirmation of PSCA-derived Sequences with HLA-DR Binding Motifs Peptide epitopes bearing an HLA class II supermotif or motif are identified and confirmed as outlined below using methodology similar to that described for HLA Class I peptides.

Selection of HLA-DR-supermotif-bearing epitopes.

To identify PSCA-derived, HLA class II HTL epitopes, a PSCA antigen is analyzed for the presence of sequences bearing an HLA-DR-motif or supermotif. Specifically, 15-mer sequences are selected comprising a DR-supermotif, comprising a 9-mer core, and three-residue N- and C-terminal flanking regions (15 amino acids total).

Protocols for predicting peptide binding to DR molecules have been developed (Southwood et al., *J. Immunol.* 160: 3363-3373, 1998). These protocols, specific for individual DR molecules, allow the scoring, and ranking, of 9-mer core regions. Each protocol not only scores peptide sequences for the presence of DR-supermotif primary anchors (i.e., at position 1 and position 6) within a 9-mer core, but additionally evaluates sequences for the presence of secondary anchors. Using allele-specific selection tables (see, e.g., Southwood et al., ibid.), it has been found that these protocols efficiently select peptide sequences with a high probability of binding a particular DR molecule. Additionally, it has been found that performing these protocols in tandem, specifically those for DR1, DR4w4, and DR7, can efficiently select DR cross-reactive peptides.

The PSCA-derived peptides identified above are tested for their binding capacity for various common HLA-DR molecules. All peptides are initially tested for binding to the DR molecules in the primary panel: DR1, DR4w4, and DR7. Peptides binding at least two of these three DR molecules are then tested for binding to DR2w2 β1, DR2w2 β2, DR6w19, and DR9 molecules in secondary assays. Finally, peptides binding at least two of the four secondary panel DR molecules, and thus cumulatively at least four of seven different DR molecules, are screened for binding to DR4w15, DR5w11, and DR8w2 molecules in tertiary assays. Peptides binding at least seven of the ten DR molecules comprising the primary, secondary, and tertiary screening assays are considered cross-reactive DR binders. PSCA-derived peptides found to bind common HLA-DR alleles are of particular interest.

Selection of DR3 motif peptides

Because HLA-DR3 is an allele that is prevalent in Caucasian, Black, and Hispanic populations, DR3 binding capacity is a relevant criterion in the selection of HTL epitopes. Thus, peptides shown to be candidates may also be assayed for their DR3 binding capacity. However, in view of the binding specificity of the DR3 motif, peptides binding only to DR3 can also be considered as candidates for inclusion in a vaccine formulation.

To efficiently identify peptides that bind DR3, target PSCA antigens are analyzed for sequences carrying one of the two DR3-specific binding motifs reported by Geluk et al. (*J. Immunol.* 152:5742-5748, 1994). The corresponding peptides are then synthesized and confirmed as having the ability to bind DR3 with an affinity of 1 µM or better, i.e., less than 1 µM. Peptides are found that meet this binding criterion and qualify as HLA class II high affinity binders.

DR3 binding epitopes identified in this manner are included in vaccine compositions with DR supermotif-bearing peptide epitopes.

Similarly to the case of HLA class I motif-bearing peptides, the class II motif-bearing peptides are analoged to improve affinity or cross-reactivity. For example, aspartic acid at position 4 of the 9-mer core sequence is an optimal residue for DR3 binding, and substitution for that residue often improves DR3 binding.

Example 17

Immunogenicity of PSCA-derived HTL Epitopes

This example determines immunogenic DR supermotif- and DR3 motif-bearing epitopes among those identified using the methodology set forth herein.

Immunogenicity of HTL epitopes are confirmed in a manner analogous to the determination of immunogenicity of CTL epitopes, by assessing the ability to stimulate HTL responses and/or by using appropriate transgenic mouse models. Immunogenicity is determined by screening for: 1.) in vitro primary induction using normal PBMC or 2.) recall responses from patients who have PSCA-expressing tumors.

Example 18

Calculation of Phenotypic Frequencies of HLA-supertypes in Various Ethnic Backgrounds to Determine Breadth of Population Coverage This example illustrates the assessment of the breadth of population coverage of a vaccine composition comprised of multiple epitopes comprising multiple supermotifs and/or motifs.

In order to analyze population coverage, gene frequencies of HLA alleles are determined. Gene frequencies for each HLA allele are calculated from antigen or allele frequencies utilizing the binomial distribution formulae gf=1−(SQRT(1−af)) (see, e.g., Sidney et al., *Human Immunol.* 45:79-93, 1996). To obtain overall phenotypic frequencies, cumulative gene frequencies are calculated, and the cumulative antigen frequencies derived by the use of the inverse formula [af=1−(1−Cgf)$^2$].

Where frequency data is not available at the level of DNA typing, correspondence to the serologically defined antigen frequencies is assumed. To obtain total potential supertype population coverage no linkage disequilibrium is assumed, and only alleles confirmed to belong to each of the supertypes are included (minimal estimates). Estimates of total potential coverage achieved by inter-loci combinations are made by adding to the A coverage the proportion of the non-A covered population that could be expected to be covered by the B alleles considered (e.g., total=A+B*(1−A)). Confirmed members of the A3-like supertype are A3, A11, A31, A*3301, and A*6801. Although the A3-like supertype may also include A34, A66, and A*7401, these alleles were not included in overall frequency calculations. Likewise, confirmed members of the A2-like supertype family are A*0201, A*0202, A*0203, A*0204, A*0205, A*0206, A*0207, A*6802, and A*6901. Finally, the B7-like supertype-confirmed alleles are: B7, B*3501-03, B51, B*5301, B*5401, B*5501-2, B*5601, B*6701, and B*7801 (potentially also B*1401, B*3504-06, B*4201, and B*5602).

Population coverage achieved by combining the A2-, A3- and B7-supertypes is approximately 86% in five major ethnic groups. Coverage may be extended by including peptides bearing the A1 and A24 motifs. On average, A1 is present in 12% and A24 in 29% of the population across five different major ethnic groups (Caucasian, North American Black, Chinese, Japanese, and Hispanic). Together, these alleles are represented with an average frequency of 39% in these same ethnic populations. The total coverage across the major ethnicities when A1 and A24 are combined with the coverage of the A2-, A3- and B7-supertype alleles is >95%, see, e.g., Table IV (G). An analogous approach can be used to estimate population coverage achieved with combinations of class II motif-bearing epitopes.

Immunogenicity studies in humans (e.g., Bertoni et al., *J. Clin. Invest.* 100:503, 1997; Doolan et al., *Immunity* 7:97, 1997; and Threlkeld et al., *J. Immunol.* 159:1648, 1997) have shown that highly cross-reactive binding peptides are almost always recognized as epitopes. The use of highly cross-reactive binding peptides is an important selection criterion in identifying candidate epitopes for inclusion in a vaccine that is immunogenic in a diverse population.

With a sufficient number of epitopes (as disclosed herein and from the art), an average population coverage is predicted to be greater than 95% in each of five major ethnic populations. The game theory Monte Carlo simulation analysis, which is known in the art (see e.g., Osborne, M. J. and Rubinstein, A. "A course in game theory" MIT Press, 1994), can be used to estimate what percentage of the individuals in a population comprised of the Caucasian, North American Black, Japanese, Chinese, and Hispanic ethnic groups would recognize the vaccine epitopes described herein. A preferred percentage is 90%. A more preferred percentage is 95%.

Example 19

CTL Recognition of Endogenously Processed Antigens After Priming

This example confirms that CTL induced by native or analoged peptide epitopes identified and selected as described herein recognize endogenously synthesized, i.e., native antigens.

Effector cells isolated from transgenic mice that are immunized with peptide epitopes, for example HLA-A2 supermotif-bearing epitopes, are re-stimulated in vitro using peptide-coated stimulator cells. Six days later, effector cells are assayed for cytotoxicity and the cell lines that contain peptide-specific cytotoxic activity are further re-stimulated. An additional six days later, these cell lines are tested for cytotoxic activity on $^{51}$Cr labeled Jurkat-A2.1/K$^b$ target cells in the absence or presence of peptide, and also tested on $^{51}$Cr labeled target cells bearing the endogenously synthesized antigen, i.e. cells that are stably transfected with PSCA expression vectors.

The results demonstrate that CTL lines obtained from animals primed with peptide epitope recognize endogenously synthesized PSCA antigen. The choice of transgenic mouse model to be used for such an analysis depends upon the epitope(s) that are being evaluated. In addition to HLA-A*0201/Kb transgenic mice, several other transgenic mouse models including mice with human A11, which may also be used to evaluate A3 epitopes, and B7 alleles have been characterized and others (e.g., transgenic mice for HLA-A1 and A24) are being developed. HLA-DR1 and HLA-DR3 mouse models have also been developed, which may be used to evaluate HTL epitopes.

Example 20

Activity of CTL-HTL Conjugated Epitopes in Transgenic Mice

This example illustrates the induction of CTLs and HTLs in transgenic mice, by use of a PSCA-derived CTL and HTL peptide vaccine compositions. The vaccine composition used herein comprise peptides to be administered to a patient with a PSCA-expressing tumor. The peptide composition can comprise multiple CTL and/or HTL epitopes. The epitopes are identified using methodology as described herein. This example also illustrates that enhanced immunogenicity can be achieved by inclusion of one or more HTL epitopes in a CTL vaccine composition; such a peptide composition can comprise an HTL epitope conjugated to a CTL epitope. The CTL epitope can be one that binds to multiple HLA family members at an affinity of 500 nM or less, or analogs of that epitope. The peptides may be lipidated, if desired.

Immunization procedures: Immunization of transgenic mice is performed as described (Alexander et al., *J. Immunol.* 159:4753-4761, 1997). For example, A2/K$^b$ mice, which are transgenic for the human HLA A2.1 allele and are used to confirm the immunogenicity of HLA-A*0201 motif- or HLA-A2 supermotif-bearing epitopes, and are primed subcutaneously (base of the tail) with a 0.1 ml of peptide in Incomplete Freund's Adjuvant, or if the peptide composition is a lipidated CTL/HTL conjugate, in DMSO/saline, or if the peptide composition is a polypeptide, in PBS or Incomplete Freund's Adjuvant. Seven days after priming, splenocytes obtained from these animals are restimulated with syngenic irradiated LPS-activated lymphoblasts coated with peptide.

Cell lines: Target cells for peptide-specific cytotoxicity assays are Jurkat cells transfected with the HLA-A2.1/K$^b$ chimeric gene (e.g., Vitiello et al., *J. Exp. Med.* 173:1007, 1991)

In vitro CTL activation: One week after priming, spleen cells ($30 \times 10^6$ cells/flask) are co-cultured at 37° C. with syngeneic, irradiated (3000 rads), peptide coated lymphoblasts ($10 \times 10^6$ cells/flask) in 10 ml of culture medium/T25 flask. After six days, effector cells are harvested and assayed for cytotoxic activity.

Assay for cytotoxic activity: Target cells (1.0 to $1.5 \times 10^6$) are incubated at 37° C. in the presence of 200 µl of $^{51}$Cr. After 60 minutes, cells are washed three times and resuspended in R10 medium. Peptide is added where required at a concentration of 1 µg/ml. For the assay, $10^{4}$ $^{51}$Cr-labeled target cells are added to different concentrations of effector cells (final volume of 200 µl) in U-bottom 96-well plates. After a six hour incubation period at 37° C., a 0.1 ml aliquot of supernatant is removed from each well and radioactivity is determined in a Micromedic automatic gamma counter. The percent specific lysis is determined by the formula: percent specific release=100×(experimental release−spontaneous release)/(maximum release−spontaneous release). To facilitate comparison between separate CTL assays run under the same conditions, % $^{51}$Cr release data is expressed as lytic units/$10^6$ cells. One lytic unit is arbitrarily defined as the number of effector cells required to achieve 30% lysis of 10,000 target cells in a six hour $^{51}$Cr release assay. To obtain specific lytic units/$10^6$, the lytic units/$10^6$ obtained in the absence of peptide is subtracted from the lytic units/$10^6$ obtained in the presence of peptide. For example, if 30% $^{51}$Cr release is obtained at the effector (E): target (T) ratio of 50:1 (i.e., $5 \times 10^5$ effector cells for 10,000 targets) in the absence of peptide and 5:1 (i.e., $5 \times 10^4$ effector cells for 10,000 targets) in the presence of peptide, the specific lytic units would be: $[(1/50,000)-(1/500,000)] \times 10^6 = 18$ LU.

The results are analyzed to assess the magnitude of the CTL responses of animals injected with the immunogenic CTL/HTL conjugate vaccine preparation and are compared to the magnitude of the CTL response achieved using, for example, CTL epitopes as outlined above in the Example entitled "Confirmation of Immunogenicity." Analyses similar to this may be performed to confirm the immunogenicity of peptide conjugates containing multiple CTL epitopes and/or multiple HTL epitopes. In accordance with these procedures, it is found that a CTL response is induced, and concomitantly that an HTL response is induced upon administration of such compositions.

Example 21

Selection of CTL and HTL Epitopes for Inclusion in a PSCA-specific Vaccine

This example illustrates a procedure for selecting peptide epitopes for vaccine compositions of the invention. The peptides in the composition can be in the form of a nucleic acid sequence, either single or one or more sequences (i.e., minigene) that encodes peptide(s), or can be single and/or polyepitopic peptides.

The following principles are utilized when selecting a plurality of epitopes for inclusion in a vaccine composition. Each of the following principles is balanced in order to make the selection.

Epitopes are selected which, upon administration, mimic immune responses that are correlated with PSCA clearance. The number of epitopes used depends on observations of patients who spontaneously clear PSCA. For example, if it has been observed that patients who spontaneously clear PSCA-expressing cells generate an immune response to at least three (3) epitopes from PSCA antigen, then at least three epitopes should be included for HLA class I. A similar rationale is used to determine HLA class II epitopes.

Epitopes are often selected that have a binding affinity of an $IC_{50}$ of 500 nM or less for an HLA class I molecule, or for class II, an $IC_{50}$ of 1000 nM or less; or HLA Class I peptides with high binding scores from the BIMAS web site, at URL bimas.dcrt.nih.gov/.

In order to achieve broad coverage of the vaccine through out a diverse population, sufficient supermotif bearing peptides, or a sufficient array of allele-specific motif bearing peptides, are selected to give broad population coverage. In one embodiment, epitopes are selected to provide at least 80% population coverage. A Monte Carlo analysis, a statistical evaluation known in the art, can be employed to assess breadth, or redundancy, of population coverage.

When creating polyepitopic compositions, or a minigene that encodes same, it is typically desirable to generate the smallest peptide possible that encompasses the epitopes of interest. The principles employed are similar, if not the same, as those employed when selecting a peptide comprising nested epitopes. For example, a protein sequence for the vaccine composition is selected because it has maximal number of epitopes contained within the sequence, i.e., it has a high concentration of epitopes. Epitopes may be nested or overlapping (i.e., frame shifted relative to one another). For example, with overlapping epitopes, two 9-mer epitopes and one 10-mer epitope can be present in a 10 amino acid peptide. Each epitope can be exposed and bound by an HLA molecule upon administration of such a peptide. A multi-epitopic, peptide can be generated synthetically, recombinantly, or via cleavage from the native source. Alternatively, an analog can be made of this native sequence, whereby one or more of the epitopes comprise substitutions that alter the cross-reactivity and/or binding affinity properties of the polyepitopic peptide. Such a vaccine composition is administered for therapeutic or prophylactic purposes. This embodiment provides for the possibility that an as yet undiscovered aspect of immune system processing will apply to the native nested sequence and thereby facilitate the production of therapeutic or prophylactic immune response-inducing vaccine compositions. Additionally such an embodiment provides for the possibility of motif-bearing epitopes for an HLA makeup that is presently unknown. Furthermore, this embodiment (absent the creating of any analogs) directs the immune response to multiple peptide sequences that are actually present in PSCA, thus avoiding the need to evaluate any junctional epitopes. Lastly, the embodiment provides an economy of scale when producing nucleic acid vaccine compositions. Related to this embodiment, computer programs can be derived in accordance with principles in the art, which identify in a target sequence, the greatest number of epitopes per sequence length.

A vaccine composition comprised of selected peptides, when administered, is safe, efficacious, and elicits an immune response similar in magnitude to an immune response that controls or clears cells that bear or overexpress PSCA.

Example 22

Construction of "Minigene" Multi-Epitope DNA Plasmids

This example discusses the construction of a minigene expression plasmid. Minigene plasmids may, of course, contain various configurations of B cell, CTL and/or HTL epitopes or epitope analogs as described herein.

A minigene expression plasmid typically includes multiple CTL and HTL peptide epitopes. In the present example, HLA-A2, -A3, -B7 supermotif-bearing peptide epitopes and HLA-A1 and -A24 motif-bearing peptide epitopes are used in conjunction with DR supermotif-bearing epitopes and/or DR3 epitopes. HLA class I supermotif or motif-bearing peptide epitopes derived PSCA, are selected such that multiple supermotifs/motifs are represented to ensure broad population coverage. Similarly, HLA class II epitopes are selected from PSCA to provide broad population coverage, i.e. both HLA DR-1-4-7 supermotif-bearing epitopes and HLA DR-3 motif-bearing epitopes are selected for inclusion in the minigene construct. The selected CTL and HTL epitopes are then incorporated into a minigene for expression in an expression vector.

Such a construct may additionally include sequences that direct the HTL epitopes to the endoplasmic reticulum. For example, the Ii protein may be fused to one or more HTL epitopes as described in the art, wherein the CLIP sequence of the Ii protein is removed and replaced with an HLA class II epitope sequence so that HLA class II epitope is directed to the endoplasmic reticulum, where the epitope binds to an HLA class II molecules.

This example illustrates the methods to be used for construction of a minigene-bearing expression plasmid. Other expression vectors that may be used for minigene compositions are available and known to those of skill in the art.

The minigene DNA plasmid of this example contains a consensus Kozak sequence and a consensus murine kappa Ig-light chain signal sequence followed by CTL and/or HTL epitopes selected in accordance with principles disclosed herein. The sequence encodes an open reading frame fused to the Myc and His antibody epitope tag coded for by the pcDNA 3.1 Myc-His vector.

Overlapping oligonucleotides that can, for example, average about 70 nucleotides in length with 15 nucleotide overlaps, are synthesized and HPLC-purified. The oligonucleotides encode the selected peptide epitopes as well as appropriate linker nucleotides, Kozak sequence, and signal sequence. The final multiepitope minigene is assembled by extending the overlapping oligonucleotides in three sets of reactions using PCR. A Perkin/Elmer 9600 PCR machine is used and a total of 30 cycles are performed using the following conditions: 95° C. for 15 sec, annealing temperature (5° below the lowest calculated Tm of each primer pair) for 30 sec, and 72° C. for 1 min.

For example, a minigene is prepared as follows. For a first PCR reaction, 5 µg of each of two oligonucleotides are annealed and extended: In an example using eight oligonucleotides, i.e., four pairs of primers, oligonucleotides 1+2, 3+4, 5+6, and 7+8 are combined in 100 µl reactions containing Pfu polymerase buffer (1x=10 mM KCL, 10 mM $(NH4)_2SO_4$, 20 mM Tris-chloride, pH 8.75, 2 mM $MgSO_4$, 0.1% Triton X-100, 100 µg/ml BSA), 0.25 mM each dNTP, and 2.5 U of Pfu polymerase. The full-length dimer products are gel-purified, and two reactions containing the product of 1+2 and 3+4, and the product of 5+6 and 7+8 are mixed, annealed, and extended for 10 cycles. Half of the two reactions are then mixed, and 5 cycles of annealing and extension carried out before flanking primers are added to amplify the full length product. The full-length product is gel-purified and cloned into pCR-blunt (Invitrogen) and individual clones are screened by sequencing.

Example 23

The Plasmid Construct and the Degree to Which it Induces Immunogenicity

The degree to which a plasmid construct, for example a plasmid constructed in accordance with the previous Example, is able to induce immunogenicity is confirmed in vitro by determining epitope presentation by APC following transduction or transfection of the APC with an epitope-expressing nucleic acid construct. Such a study determines "antigenicity" and allows the use of human APC. The assay determines the ability of the epitope to be presented by the APC in a context that is recognized by a T cell by quantifying the density of epitope-HLA class I complexes on the cell surface. Quantitation can be performed by directly measuring the amount of peptide eluted from the APC (see, e.g., Sijts et al., *J. Immunol.* 156:683-692, 1996; Demotz et al., *Nature*

342:682-684, 1989); or the number of peptide-HLA class I complexes can be estimated by measuring the amount of lysis or lymphokine release induced by diseased or transfected target cells, and then determining the concentration of peptide necessary to obtain equivalent levels of lysis or lymphokine release (see, e.g., Kageyama et al., *J. Immunol.* 154:567-576, 1995).

Alternatively, immunogenicity is confirmed through in vivo injections into mice and subsequent in vitro assessment of CTL and HTL activity, which are analyzed using cytotoxicity and proliferation assays, respectively, as detailed e.g., in Alexander et al., *Immunity* 1:751-761, 1994.

For example, to confirm the capacity of a DNA minigene construct containing at least one HLA-A2 supermotif peptide to induce CTLs in vivo, HLA-A2.1/$K^b$ transgenic mice, for example, are immunized intramuscularly with 100 μg of naked cDNA. As a means of comparing the level of CTLs induced by cDNA immunization, a control group of animals is also immunized with an actual peptide composition that comprises multiple epitopes synthesized as a single polypeptide as they would be encoded by the minigene.

Splenocytes from immunized animals are stimulated twice with each of the respective compositions (peptide epitopes encoded in the minigene or the polyepitopic peptide), then assayed for peptide-specific cytotoxic activity in a $^{51}$Cr release assay. The results indicate the magnitude of the CTL response directed against the A2-restricted epitope, thus indicating the in vivo immunogenicity of the minigene vaccine and polyepitopic vaccine.

It is, therefore, found that the minigene elicits immune responses directed toward the HLA-A2 supermotif peptide epitopes as does the polyepitopic peptide vaccine. A similar analysis is also performed using other HLA-A3 and HLA-B7 transgenic mouse models to assess CTL induction by HLA-A3 and HLA-B7 motif or supermotif epitopes, whereby it is also found that the minigene elicits appropriate immune responses directed toward the provided epitopes.

To confirm the capacity of a class II epitope-encoding minigene to induce HTLs in vivo, DR transgenic mice, or for those epitopes that cross react with the appropriate mouse MHC molecule, I-$A^b$-restricted mice, for example, are immunized intramuscularly with 100 μg of plasmid DNA. As a means of comparing the level of HTLs induced by DNA immunization, a group of control animals is also immunized with an actual peptide composition emulsified in complete Freund's adjuvant. CD4+ T cells, i.e. HTLs, are purified from splenocytes of immunized animals and stimulated with each of the respective compositions (peptides encoded in the minigene). The HTL response is measured using a $^3$H-thymidine incorporation proliferation assay, (see, e.g., Alexander et al. Immunity 1:751-761, 1994). The results indicate the magnitude of the HTL response, thus demonstrating the in vivo immunogenicity of the minigene.

DNA minigenes, constructed as described in the previous Example, can also be confirmed as a vaccine in combination with a boosting agent using a prime boost protocol. The boosting agent can consist of recombinant protein (e.g., Barnett et al., *Aids Res. and Human Retroviruses* 14, Supplement 3:S299-S309, 1998) or recombinant vaccinia, for example, expressing a minigene or DNA encoding the complete protein of interest (see, e.g., Hanke et al., *Vaccine* 16:439-445, 1998; Sedegah et al., *Proc. Natl. Acad. Sci USA* 95:7648-53, 1998; Hanke and McMichael, *Immunol. Letters* 66:177-181, 1999; and Robinson et al., *Nature Med.* 5:526-34, 1999).

For example, the efficacy of the DNA minigene used in a prime boost protocol is initially evaluated in transgenic mice. In this example, A2.1/$K^b$ transgenic mice are immunized IM with 100 μg of a DNA minigene encoding the immunogenic peptides including at least one HLA-A2 supermotif-bearing peptide. After an incubation period (ranging from 3-9 weeks), the mice are boosted IP with $10^7$ pfu/mouse of a recombinant vaccinia virus expressing the same sequence encoded by the DNA minigene. Control mice are immunized with 100 μg of DNA or recombinant vaccinia without the minigene sequence, or with DNA encoding the minigene, but without the vaccinia boost. After an additional incubation period of two weeks, splenocytes from the mice are immediately assayed for peptide-specific activity in an ELISPOT assay. Additionally, splenocytes are stimulated in vitro with the A2-restricted peptide epitopes encoded in the minigene and recombinant vaccinia, then assayed for peptide-specific activity in an alpha, beta and/or gamma IFN ELISA.

It is found that the minigene utilized in a prime-boost protocol elicits greater immune responses toward the HLA-A2 supermotif peptides than with DNA alone. Such an analysis can also be performed using HLA-A11 or HLA-B7 transgenic mouse models to assess CTL induction by HLA-A3 or HLA-B7 motif or supermotif epitopes. The use of prime boost protocols in humans is described below in the Example entitled "Induction of CTL Responses Using a Prime Boost Protocol."

Example 24

Peptide Compositions for Prophylactic Uses

Vaccine compositions of the present invention can be used to prevent PSCA expression in persons who are at risk for tumors that bear this antigen. For example, a polyepitopic peptide epitope composition (or a nucleic acid comprising the same) containing multiple CTL and HTL epitopes such as those selected in the above Examples, which are also selected to target greater than 80% of the population, is administered to individuals at risk for a PSCA-associated tumor.

For example, a peptide-based composition is provided as a single polypeptide that encompasses multiple epitopes. The vaccine is typically administered in a physiological solution that comprises an adjuvant, such as Incomplete Freunds Adjuvant. The dose of peptide for the initial immunization is from about 1 to about 50,000 μg, generally 100-5,000 μg, for a 70 kg patient. The initial administration of vaccine is followed by booster dosages at 4 weeks followed by evaluation of the magnitude of the immune response in the patient, by techniques that determine the presence of epitope-specific CTL populations in a PBMC sample. Additional booster doses are administered as required. The composition is found to be both safe and efficacious as a prophylaxis against PSCA-associated disease.

Alternatively, a composition typically comprising transfecting agents is used for the administration of a nucleic acid-based vaccine in accordance with methodologies known in the art and disclosed herein.

Example 25

Polyepitopic Vaccine Compositions Derived from Native PSCA Sequences

A native PSCA polyprotein sequence is analyzed, preferably using computer algorithms defined for each class I and/or class II supermotif or motif, to identify "relatively short" regions of the polyprotein that comprise multiple epitopes. The "relatively short" regions are preferably less in length than an entire native antigen. This relatively short sequence that contains multiple distinct or overlapping, "nested" epitopes can be used to generate a minigene construct. The construct is engineered to express the peptide, which corresponds to the native protein sequence. The "relatively short" peptide is generally less than 250 amino acids in length, often less than 100 amino acids in length, preferably less than 75 amino acids in length, and more preferably less than 50 amino acids in length. The protein sequence of the vaccine composition is selected because it has maximal number of epitopes contained within the sequence, i.e., it has a high concentration of epitopes. As noted herein, epitope motifs may be nested or overlapping (i.e., frame shifted relative to one another). For example, with overlapping epitopes, two 9-mer epitopes and one 10-mer epitope can be present in a 10 amino acid peptide. Such a vaccine composition is administered for therapeutic or prophylactic purposes.

The vaccine composition will include, for example, multiple CTL epitopes from PSCA antigen and at least one HTL epitope. This polyepitopic native sequence is administered either as a peptide or as a nucleic acid sequence which encodes the peptide. Alternatively, an analog can be made of this native sequence, whereby one or more of the epitopes comprise substitutions that alter the cross-reactivity and/or binding affinity properties of the polyepitopic peptide.

The embodiment of this example provides for the possibility that an as yet undiscovered aspect of immune system processing will apply to the native nested sequence and thereby facilitate the production of therapeutic or prophylactic immune response-inducing vaccine compositions. Additionally, such an embodiment provides for the possibility of motif-bearing epitopes for an HLA makeup(s) that is presently unknown. Furthermore, this embodiment (excluding an analoged embodiment) directs the immune response to multiple peptide sequences that are actually present in native PSCA, thus avoiding the need to evaluate any junctional epitopes. Lastly, the embodiment provides an economy of scale when producing peptide or nucleic acid vaccine compositions.

Related to this embodiment, computer programs are available in the art which can be used to identify in a target sequence, the greatest number of epitopes per sequence length.

Example 26

Polyepitopic Vaccine Compositions from Multiple Antigens

The PSCA peptide epitopes of the present invention are used in conjunction with epitopes from other target tumor-associated antigens, to create a vaccine composition that is useful for the prevention or treatment of cancer that expresses PSCA and such other antigens. For example, a vaccine composition can be provided as a single polypeptide that incorporates multiple epitopes from PSCA as well as tumor-associated antigens that are often expressed with a target cancer associated with PSCA expression, or can be administered as a composition comprising a cocktail of one or more discrete epitopes. Alternatively, the vaccine can be administered as a minigene construct or as dendritic cells which have been loaded with the peptide epitopes in vitro.

Example 27

Use of Peptides to Evaluate an Immune Response

Peptides of the invention may be used to analyze an immune response for the presence of specific antibodies, CTL or HTL directed to PSCA. Such an analysis can be performed in a manner described by Ogg et al., Science 279:2103-2106, 1998. In this Example, peptides in accordance with the invention are used as a reagent for diagnostic or prognostic purposes, not as an immunogen.

In this example highly sensitive human leukocyte antigen tetrameric complexes ("tetramers") are used for a cross-sectional analysis of, for example, PSCA HLA-A*0201-specific CTL frequencies from HLA A*0201-positive individuals at different stages of disease or following immunization comprising a PSCA peptide containing an A*0201 motif. Tetrameric complexes are synthesized as described (Musey et al., N. Engl. J. Med. 337:1267, 1997). Briefly, purified HLA heavy chain (A*0201 in this example) and β2-microglobulin are synthesized by means of a prokaryotic expression system. The heavy chain is modified by deletion of the transmembrane-cytosolic tail and COOH-terminal addition of a sequence containing a BirA enzymatic biotinylation site. The heavy chain, β2-microglobulin, and peptide are refolded by dilution. The 45-kD refolded product is isolated by fast protein liquid chromatography and then biotinylated by BirA in the presence of biotin (Sigma, St. Louis, Mo.), adenosine 5' triphosphate and magnesium. Streptavidin-phycoerythrin conjugate is added in a 1:4 molar ratio, and the tetrameric product is concentrated to 1 mg/ml. The resulting product is referred to as tetramer-phycoerythrin.

For the analysis of patient blood samples, approximately one million PBMCs are centrifuged at 300 g for 5 minutes and resuspended in 50 µl of cold phosphate-buffered saline. Tricolor analysis is performed with the tetramer-phycoerythrin, along with anti-CD8-Tricolor, and anti-CD38. The PBMCs are incubated with tetramer and antibodies on ice for 30 to 60 min and then washed twice before formaldehyde fixation. Gates are applied to contain >99.98% of control samples. Controls for the tetramers include both A*0201-negative individuals and A*0201-positive non-diseased donors. The percentage of cells stained with the tetramer is then determined by flow cytometry. The results indicate the number of cells in the PBMC sample that contain epitope-restricted CTLs, thereby readily indicating the extent of immune response to the PSCA epitope, and thus the status of exposure to PSCA, or exposure to a vaccine that elicits a protective or therapeutic response.

Example 28

Use of Peptide Epitopes to Evaluate Recall Responses

The peptide epitopes of the invention are used as reagents to evaluate T cell responses, such as acute or recall responses, in patients. Such an analysis may be performed on patients who have recovered from PSCA-associated disease or who have been vaccinated with a PSCA vaccine.

For example, the class I restricted CTL response of persons who have been vaccinated may be analyzed. The vaccine may be any PSCA vaccine. PBMC are collected from vaccinated individuals and HLA typed. Appropriate peptide epitopes of the invention that, optimally, bear supermotifs to provide cross-reactivity with multiple HLA supertype family members, are then used for analysis of samples derived from individuals who bear that HLA type.

PBMC from vaccinated individuals are separated on Ficoll-Histopaque density gradients (Sigma Chemical Co., St. Louis, Mo.), washed three times in HBSS (GIBCO Laboratories), resuspended in RPMI-1640 (GIBCO Laboratories) supplemented with L-glutamine (2 mM), penicillin (50

U/ml), streptomycin (50 µg/ml), and Hepes (10 mM) containing 10% heat-inactivated human AB serum (complete RPMI) and plated using microculture formats. A synthetic peptide comprising an epitope of the invention is added at 10 µg/ml to each well and HBV core 128-140 epitope is added at 1 µg/ml to each well as a source of T cell help during the first week of stimulation.

In the microculture format, $4 \times 10^5$ PBMC are stimulated with peptide in 8 replicate cultures in 96-well round bottom plate in 100 µl/well of complete RPMI. On days 3 and 10, 100 µl of complete RPMI and 20 U/ml final concentration of rIL-2 are added to each well. On day 7 the cultures are transferred into a 96-well flat-bottom plate and restimulated with peptide, rIL-2 and $10^5$ irradiated (3,000 rad) autologous feeder cells. The cultures are tested for cytotoxic activity on day 14. A positive CTL response requires two or more of the eight replicate cultures to display greater than 10% specific $^{51}Cr$ release, based on comparison with non-diseased control subjects as previously described (Rehermann, et al., *Nature Med.* 2:1104,1108, 1996; Rehermann et al., *J. Clin. Invest.* 97:1655-1665, 1996; and Rehermann et al. *J. Clin. Invest.* 98:1432-1440, 1996).

Target cell lines are autologous and allogeneic EBV-transformed B-LCL that are either purchased from the American Society for Histocompatibility and Immunogenetics (ASHI, Boston, Mass.) or established from the pool of patients as described (Guilhot, et al. *J. Virol.* 66:2670-2678, 1992).

Cytotoxicity assays are performed in the following manner. Target cells consist of either allogeneic HLA-matched or autologous EBV-transformed B lymphoblastoid cell line that are incubated overnight with the synthetic peptide epitope of the invention at 10 µM, and labeled with 100 µCi of $^{51}Cr$ (Amersham Corp., Arlington Heights, Ill.) for 1 hour after which they are washed four times with HBSS.

Cytolytic activity is determined in a standard 4-h, split well $^{51}Cr$ release assay using U-bottomed 96 well plates containing 3,000 targets/well. Stimulated PBMC are tested at effector/target (E/T) ratios of 20-50:1 on day 14. Percent cytotoxicity is determined from the formula: $100 \times [(\text{experimental release-spontaneous release})/\text{maximum release-spontaneous release})]$. Maximum release is determined by lysis of targets by detergent (2% Triton X-100; Sigma Chemical Co., St. Louis, Mo.). Spontaneous release is <25% of maximum release for all experiments.

The results of such an analysis indicate the extent to which HLA-restricted CTL populations have been stimulated by previous exposure to PSCA or a PSCA vaccine.

Similarly, Class II restricted HTL responses may also be analyzed. Purified PBMC are cultured in a 96-well flat bottom plate at a density of $1.5 \times 10^5$ cells/well and are stimulated with 10 µg/ml synthetic peptide of the invention, whole PSCA antigen, or PHA. Cells are routinely plated in replicates of 4-6 wells for each condition. After seven days of culture, the medium is removed and replaced with fresh medium containing 10 U/ml IL-2. Two days later, 1 µCi $^3H$-thymidine is added to each well and incubation is continued for an additional 18 hours. Cellular DNA is then harvested on glass fiber mats and analyzed for $^3H$-thymidine incorporation. Antigen-specific T cell proliferation is calculated as the ratio of $^3H$-thymidine incorporation in the presence of antigen divided by the $^3H$-thymidine incorporation in the absence of antigen.

Example 29

Induction of Specific CTL Response in Humans

A human clinical trial for an immunogenic composition comprising CTL and HTL epitopes of the invention is set up as an IND Phase I, dose escalation study and carried out as a randomized, double-blind, placebo-controlled trial. Such a trial is designed, for example, as follows:

A total of about 27 individuals are enrolled and divided into 3 groups:

Group I: 3 subjects are injected with placebo and 6 subjects are injected with 5 µg of peptide composition;

Group II: 3 subjects are injected with placebo and 6 subjects are injected with 50 µg peptide composition;

Group III: 3 subjects are injected with placebo and 6 subjects are injected with 500 µg of peptide composition.

After 4 weeks following the first injection, all subjects receive a booster inoculation at the same dosage.

The endpoints measured in this study relate to the safety and tolerability of the peptide composition as well as its immunogenicity. Cellular immune responses to the peptide composition are an index of the intrinsic activity of this the peptide composition, and can therefore be viewed as a measure of biological efficacy. The following summarize the clinical and laboratory data that relate to safety and efficacy endpoints.

Safety: The incidence of adverse events is monitored in the placebo and drug treatment group and assessed in terms of degree and reversibility.

Evaluation of Vaccine Efficacy: For evaluation of vaccine efficacy, subjects are bled before and after injection. Peripheral blood mononuclear cells are isolated from fresh heparinized blood by Ficoll-Hypaque density gradient centrifugation, aliquoted in freezing media and stored frozen. Samples are assayed for CTL and HTL activity.

The vaccine is found to be both safe and efficacious.

Example 30

Phase II Trials in Patients Expressing PSCA

Phase II trials are performed to study the effect of administering the CTL-HTL peptide compositions to patients having cancer that expresses PSCA. The main objectives of the trial are to determine an effective dose and regimen for inducing CTLs in cancer patients that express PSCA, to establish the safety of inducing a CTL and HTL response in these patients, and to see to what extent activation of CTLs improves the clinical picture of these patients, as manifested, e.g., by the reduction and/or shrinking of lesions. Such a study is designed, for example, as follows:

The studies are performed in multiple centers. The trial design is an open-label, uncontrolled, dose escalation protocol wherein the peptide composition is administered as a single dose followed six weeks later by a single booster shot of the same dose. The dosages are 50, 500 and 5,000 micrograms per injection. Drug-associated adverse effects (severity and reversibility) are recorded.

There are three patient groupings. The first group is injected with 50 micrograms of the peptide composition and the second and third groups with 500 and 5,000 micrograms of peptide composition, respectively. The patients within each group range in age from 21-65 and represent diverse ethnic backgrounds. All of them have a tumor that expresses PSCA.

Clinical manifestations or antigen-specific T-cell responses are monitored to assess the effects of administering the peptide compositions. The vaccine composition is found to be both safe and efficacious in the treatment of PSCA-associated disease.

Example 31

Induction of CTL Responses Using a Prime Boost Protocol

A prime boost protocol similar in its underlying principle to that used to confirm the efficacy of a DNA vaccine in transgenic mice, such as described above in the Example entitled "The Plasmid Construct and the Degree to Which It Induces Immunogenicity," can also be used for the administration of the vaccine to humans. Such a vaccine regimen can include an initial administration of, for example, naked DNA followed by a boost using recombinant virus encoding the vaccine, or recombinant protein/polypeptide or a peptide mixture administered in an adjuvant.

For example, the initial immunization may be performed using an expression vector, such as that constructed in the Example entitled "Construction of "Minigene" Multi-Epitope DNA Plasmids" in the form of naked nucleic acid administered IM (or SC or ID) in the amounts of 0.5-5 mg at multiple sites. The nucleic acid (0.1 to 1000 μg) can also be administered using a gene gun. Following an incubation period of 3-4 weeks, a booster dose is then administered. The booster can be recombinant fowlpox virus administered at a dose of $5-10^7$ to $5 \times 10^9$ pfu. An alternative recombinant virus, such as an MVA, canarypox, adenovirus, or adeno-associated virus, can also be used for the booster, or the polyepitopic protein or a mixture of the peptides can be administered. For evaluation of vaccine efficacy, patient blood samples are obtained before immunization as well as at intervals following administration of the initial vaccine and booster doses of the vaccine. Peripheral blood mononuclear cells are isolated from fresh heparinized blood by Ficoll-Hypaque density gradient centrifugation, aliquoted in freezing media and stored frozen. Samples are assayed for CTL and HTL activity.

Analysis of the results indicates that a magnitude of response sufficient to achieve a therapeutic or protective immunity against PSCA is generated.

Example 32

Administration of Vaccine Compositions Using Dendritic Cells (DC)

Vaccines comprising peptide epitopes of the invention can be administered using APCs, or "professional" APCs such as DC. In this example, peptide-pulsed DC are administered to a patient to stimulate a CTL response in vivo. In this method, dendritic cells are isolated, expanded, and pulsed with a vaccine comprising peptide CTL and HTL epitopes of the invention. The dendritic cells are infused back into the patient to elicit CTL and HTL responses in vivo. The induced CTL and HTL then destroy or facilitate destruction, respectively, of the target cells that bear the PSCA protein from which the epitopes in the vaccine are derived.

For example, a cocktail of epitope-comprising peptides is administered ex vivo to PBMC, or isolated DC therefrom. A pharmaceutical to facilitate harvesting of DC can be used, such as Progenipoietin™ (Monsanto, St. Louis, Mo.) or GM-CSF/IL-4. After pulsing the DC with peptides, and prior to reinfusion into patients, the DC are washed to remove unbound peptides.

As appreciated clinically, and readily determined by one of skill based on clinical outcomes, the number of DC reinfused into the patient can vary (see, e.g., *Nature Med.* 4:328, 1998; *Nature Med.* 2:52, 1996 and *Prostate* 32:272, 1997). Although $2\text{-}50 \times 10^6$ DC per patient are typically administered, larger number of DC, such as $10^7$ or $10^8$ can also be provided. Such cell populations typically contain between 50-90% DC.

In some embodiments, peptide-loaded PBMC are injected into patients without purification of the DC. For example, PBMC generated after treatment with an agent such as Progenipoietin™ are injected into patients without purification of the DC. The total number of PBMC that are administered often ranges from $10^8$ to $10^{10}$. Generally, the cell doses injected into patients is based on the percentage of DC in the blood of each patient, as determined, for example, by immunofluorescence analysis with specific anti-DC antibodies. Thus, for example, if Progenipoietin™ mobilizes 2% DC in the peripheral blood of a given patient, and that patient is to receive $5 \times 10^6$ DC, then the patient will be injected with a total of $2.5 \times 10^8$ peptide-loaded PBMC. The percent DC mobilized by an agent such as Progenipoietin™ is typically estimated to be between 2-10%, but can vary as appreciated by one of skill in the art.

Ex vivo activation of CTL/HTL responses

Alternatively, ex vivo CTL or HTL responses to PSCA antigens can be induced by incubating, in tissue culture, the patient's, or genetically compatible, CTL or HTL precursor cells together with a source of APC, such as DC, and immunogenic peptides. After an appropriate incubation time (typically about 7-28 days), in which the precursor cells are activated and expanded into effector cells, the cells are infused into the patient, where they will destroy (CTL) or facilitate destruction (HTL) of their specific target cells, i.e., tumor cells.

Example 33

An Alternative Method of Identifying and Confirming Motif-Bearing Peptides

Another method of identifying and confirming motif-bearing peptides is to elute them from cells bearing defined MHC molecules. For example, EBV transformed B cell lines used for tissue typing have been extensively characterized to determine which HLA molecules they express. In certain cases these cells express only a single type of HLA molecule. These cells can be transfected with nucleic acids that express the antigen of interest, e.g. PSCA. Peptides produced by endogenous antigen processing of peptides produced as a result of transfection will then bind to HLA molecules within the cell and be transported and displayed on the cell's surface. Peptides are then eluted from the HLA molecules by exposure to mild acid conditions and their amino acid sequence determined, e.g., by mass spectral analysis (e.g., Kubo et al., *J. Immunol.* 152:3913, 1994). Because the majority of peptides that bind a particular HLA molecule are motif-bearing, this is an alternative modality for obtaining the motif-bearing peptides correlated with the particular HLA molecule expressed on the cell.

Alternatively, cell lines that do not express endogenous HLA molecules can be transfected with an expression construct encoding a single HLA allele. These cells can then be used as described, i.e., they can then be transfected with nucleic acids that encode PSCA to isolate peptides corresponding to PSCA that have been presented on the cell surface. Peptides obtained from such an analysis will bear motif (s) that correspond to binding to the single HLA allele that is expressed in the cell.

As appreciated by one in the art, one can perform a similar analysis on a cell bearing more than one HLA allele and subsequently determine peptides specific for each HLA allele expressed. Moreover, one of skill would also recognize that means other than transfection, such as loading with a protein antigen, can be used to provide a source of antigen to the cell.

Example 34

Complementary Polynucleotides

Sequences complementary to the PSCA-encoding sequences, or any parts thereof, are used to detect, decrease, or inhibit expression of naturally occurring PSCA. Although use of oligonucleotides comprising from about 15 to 30 base pairs is described, essentially the same procedure is used with smaller or with larger sequence fragments. Appropriate oligonucleotides are designed using, e.g., OLIGO 4.06 software (National Biosciences) and the coding sequence of PSCA. To inhibit transcription, a complementary oligonucleotide is designed from the most unique 5' sequence and used to prevent promoter binding to the coding sequence. To inhibit translation, a complementary oligonucleotide is designed to prevent ribosomal binding to a PSCA-encoding transcript.

Example 35

Purification of Naturally-occurring or Recombinant PSCA Using PSCA-Specific Antibodies Naturally occurring or recombinant PSCA is substantially purified by immunoaffinity chromatography using antibodies specific for PSCA. An immunoaffinity column is constructed by covalently coupling anti-PSCA antibody to an activated chromatographic resin, such as CNBr-activated SEPHAROSE (Amersham Pharmacia Biotech). After the coupling, the resin is blocked and washed according to the manufacturer's instructions.

Media containing PSCA are passed over the immunoaffinity column, and the column is washed under conditions that allow the preferential absorbance of PSCA (e.g., high ionic strength buffers in the presence of detergent). The column is eluted under conditions that disrupt antibody/PSCA binding (e.g., a buffer of pH 2 to pH 3, or a high concentration of a chaotrope, such as urea or thiocyanate ion), and GCR.P is collected.

Example 36

Identification of Molecules Which Interact with PSCA

PSCA, or biologically active fragments thereof, are labeled with 121 1 Bolton-Hunter reagent. (See, e.g., Bolton et al. (1973) Biochem. J. 133:529.) Candidate molecules previously arrayed in the wells of a multi-well plate are incubated with the labeled PSCA, washed, and any wells with labeled PSCA complex are assayed. Data obtained using different concentrations of PSCA are used to calculate values for the number, affinity, and association of PSCA with the candidate molecules.

Example 37

In Vivo Assay for PSCA v.4 Tumor Growth Promotion

The effect of the PSCA v.4 protein on tumor cell growth is evaluated in vivo by evaluating tumor development and growth of cells expressing or lacking PSCA v.4. For example, SCID mice are injected subcutaneously on each flank with $1 \times 10^6$ of either 3T3, prostate (e.g. PC3 cells), bladder (e.g. UM-UC3 cells) or pancreas (e.g. PANC1 cells) cancer cell lines containing tkNeo empty vector or PSCA v.4. At least two strategies may be used: (1) Constitutive PSCA v.4 expression under regulation of a promoter such as a constitutive promoter obtained from the genomes of viruses such as polyoma virus, fowlpox virus (UK 2,211,504 published 5 Jul. 1989), adenovirus (such as Adenovirus 2), bovine papilloma virus, avian sarcoma virus, cytomegalovirus, a retrovirus, hepatitis-B virus and Simian Virus 40 (SV40), or from heterologous mammalian promoters, e.g., the actin promoter or an immunoglobulin promoter, provided such promoters are compatible with the host cell systems, and (2) Regulated expression under control of an inducible vector system, such as ecdysone, tetracycline, etc., provided such promoters are compatible with the host cell systems. Tumor volume is then monitored by caliper measurement at the appearance of palpable tumors and followed over time to determine if PSCA v.4-expressing cells grow at a faster rate and whether tumors produced by PSCA v.4-expressing cells demonstrate characteristics of altered aggressiveness (e.g. enhanced metastasis, vascularization, reduced responsiveness to chemotherapeutic drugs).

Additionally, mice can be implanted with $1 \times 10^5$ of the same cells orthotopically to determine if PSCA v.4 has an effect on local growth in the pancreas, and whether PSCA v.4 affects the ability of the cells to metastasize, specifically to lymph nodes, and bone (Miki T et al, Oncol Res. 2001;12: 209; Fu X et al, Int. J Cancer. 1991, 49:938). The effect of PSCA v.4 on bone tumor formation and growth may be assessed by injecting tumor cells intratibially.

The assay is also useful to determine the PSCA v.4 inhibitory effect of candidate therapeutic compositions, such as for example, PSCA v.4 intrabodies, PSCA v.4 antisense molecules and ribozymes.

Example 38

PSCA v.4 Monoclonal Antibody-mediated Inhibition of Tumors In Vivo

The significant expression of PSCA v.4 in cancer tissues, together with its restrictive expression in normal tissues makes PSCA v.4 a good target for antibody therapy. Similarly, PSCA v.4 is a target for T cell-based immunotherapy. Thus, the therapeutic efficacy of anti-PSCA v.4 mAbs in human cancer xenograft mouse models, including prostate, bladder, and pancreas (e.g. PANC1 cells) and other -PSCA v.4 cancers listed in table 1, is evaluated by using recombinant cell lines such as PC3-PSCA v.4, UM-UC3-PSCA v.4, PANC1-PSCA v.4, and 3T3-PSCA v.4 (see, e.g., Kaighn, M. E., et al., Invest Urol, 1979. 17(1): 16-23), as well as human xenograft models (Saffran et al PNAS 1999, 10:1073-1078).

Antibody efficacy on tumor growth and metastasis formation is studied, e.g., in a mouse orthotopic ovary, pancreas, or blood cancer xenograft models. The antibodies can be unconjugated, as discussed in this Example, or can be conjugated to a therapeutic modality, as appreciated in the art. Anti-PSCA v.4 mAbs inhibit formation of tumors in mouse xenografts. Anti-PSCA v.4 mAbs also retard the growth of established orthotopic tumors and prolonged survival of tumor-bearing mice. These results indicate the utility of anti-PSCA v.4 mAbs in the treatment of local and advanced stages several solid tumors. (See, e.g., Saffran, D., et al., PNAS 10:1073-1078 or world wide web URL pnas.org/cgi/doi/10.1073/pnas.051624698).

Administration of the anti-PSCA v.4 mAbs led to retardation of established orthotopic tumor growth and inhibition of metastasis to distant sites, resulting in a significant prolongation in the survival of tumor-bearing mice. These studies indicate that PSCA v.4 as an attractive target for immunotherapy and demonstrate the therapeutic potential of anti-PSCA v.4 mAbs for the treatment of local and metastatic cancer. This example indicates that unconjugated PSCA v.4 monoclonal antibodies are effective to inhibit the growth of human pancreatic, ovarian, and lymphomas tumor xenografts grown in SCID mice; accordingly a combination of such efficacious monoclonal antibodies is also effective.

Tumor inhibition using multiple unconjugated PSCA v.4 mAbs

Materials and Methods

PSCA v.4 Monoclonal Antibodies:

Monoclonal antibodies are raised against PSCA v.4 as described in the Example entitled "Generation of PSCA v.4 Monoclonal Antibodies (mAbs)." The antibodies are characterized by ELISA, Western blot, FACS, and immunoprecipitation for their capacity to bind PSCA v.4. Epitope mapping data for the anti-PSCA v.4 mAbs, as determined by ELISA and Western analysis, recognize epitopes on the PSCA v.4 protein. Immunohistochemical analysis of cancer tissues and cells with these antibodies is performed.

The monoclonal antibodies are purified from ascites or hybridoma tissue culture supernatants by Protein-G Sepharose chromatography, dialyzed against PBS, filter sterilized, and stored at -31 20° C. Protein determinations are performed by a Bradford assay (Bio-Rad, Hercules, Calif.). A therapeutic monoclonal antibody or a cocktail comprising a mixture of individual monoclonal antibodies is prepared and used for the treatment of mice receiving subcutaneous or orthotopic injections of PC3, UM-UC3, CaKi, and A427 tumor xenografts.

Cell Lines and Xenografts

The LAPC-9 xenograft, which expresses a wild-type androgen receptor and produces prostate-specific antigen (PSA), is passaged in 6- to 8-week-old male ICR-severe combined immunodeficient (SCID) mice (Taconic Farms) by s.c. trocar implant (Craft, N., et al., 1999, Cancer Res. 59:5030-5036). The AGS-K3 and AGS-K6 kidney xenografts are also passaged by subcutaneous implants in 6- to 8-week old SCID mice. Single-cell suspensions of tumor cells are prepared as described in Craft, et al.

The cancer cell lines PC3, UM-UC3 and PANC1 cell lines, as well as the fibroblast line NIH 3T3 (American Type Culture Collection). The prostate carcinoma cell line PC3 is maintained in RPMI supplemented with L-glutamine and 10% FBS, and the bladder and pancreas carcinoma lines, UM-UC3 and PANC1 respectively, are maintained in DMEM supplemented with L-glutamine and 10% FBS. PC3-PSCA v.4, UM-UC3-PSCA v.4, PANC1-PSCA v.4 and 3T3-PSCA v.4 cell populations are generated by retroviral gene transfer as described in Hubert, R. S., et al., Proc Natl. Acad. Sci U S A, 1999. 96(25): 14523.

Xenograft Mouse Models.

Subcutaneous (s.c.) tumors are generated by injection of $2\times10^6$ cancer cells mixed at a 1:1 dilution with Matrigel (Collaborative Research) in the right flank of male SCID mice. To test antibody efficacy on tumor formation, i.e. antibody injections are started on the same day as tumor-cell injections. As a control, mice are injected with either purified mouse IgG (ICN) or PBS; or a purified monoclonal antibody that recognizes an irrelevant antigen not expressed in human cells. In preliminary studies, no difference is found between mouse IgG or PBS on tumor growth. Tumor sizes are determined by caliper measurements, and the tumor volume is calculated as length×width×height. Mice with Subcutaneous tumors greater than 1.5 cm in diameter are sacrificed.

Orthotopic injections are performed under anesthesia by using ketamine/xylazine. For prostate orthotopic studies, an incision is made through the abdominal muscles to expose the bladder and seminal vesicles, which then are delivered through the incision to expose the dorsal prostate. LAPC-9 cells (5×105) mixed with Matrigel are injected into each dorsal lobe in a 10 μl volume. To monitor tumor growth, mice are bled on a weekly basis for determination of PSA levels. For pancreas orthotoptic model, an incision is made through the abdominal muscles to expose the mammary tissues and a single cell suspension of pancreas cancer cells is injected into the mammary pad. For the bladder orthotopic model, AGS-B1 bladder cancer tissue is adhered onto the bladder wall. Following tumor implantation, the mice are segregated into groups for the appropriate treatments, with anti-PSCA v.4 or control mAbs being injected i.p. To monitor tumor growth, mice are palpated and blood is collected on a weekly basis to measure hCG levels.

Anti-PSCA v.4 mAbs Inhibit Growth of PSCA v.4-Expressing Xenograft-Cancer Tumors The effect of anti-PSCA v.4 mAbs on tumor formation is tested by using cell line (e.g. PC3, UM-UC3, PANC1 and 3T3) and patient-derived tumor orthotopic models. As compared with the s.c. tumor model, the orthotopic model, which requires injection of tumor cells directly in the mouse organ results in a local tumor growth, development of metastasis in distal sites, deterioration of mouse health, and subsequent death (Saffran, D., et al., PNAS supra). The features make the orthotopic model more representative of human disease progression and allowed us to follow the therapeutic effect of mAbs on clinically relevant end points.

A major advantage of the orthotopic cancer models is the ability to study the development of metastases. Formation of metastasis in mice bearing established orthotopic tumors is studies by IHC analysis on lung sections using an antibody against a tumor-specific cell-surface protein such as anti-CK20 for prostate cancer (Lin S et al, Cancer Detect Prev. 2001;25:202).

Another advantage of xenograft cancer models is the ability to study neovascularization and angiogenesis. Tumor growth is partly dependent on new blood vessel development. Although the capillary system and developing blood network is of host origin, the initiation and architecture of the neovasculature is regulated by the xenograft tumor (Davidoff A M et al, Clin Cancer Res. 2001;7:2870; Solesvik O et al,, Eur. J Cancer Clin Oncol. 1984, 20:1295). The effect of antibody and small molecule on neovascularization is studied in accordance with procedures known in the art, such as by IHC analysis of tumor tissues and their surrounding microenvironment.

Mice bearing established orthotopic tumors are administered 1000 μg injections of either anti-PSCA v.4 mAb or PBS over a 4-week period. Mice in both groups are allowed to establish a high tumor burden, to ensure a high frequency of metastasis formation in mouse lungs. Mice then are killed and their bladders, livers, bone and lungs are analyzed for the presence of tumor cells by IHC analysis. These studies demonstrate a broad anti-tumor efficacy of anti-PSCA v.4 antibodies on initiation and progression of prostate cancer in xenograft mouse models. Anti-PSCA v.4 antibodies inhibit tumor formation of tumors as well as retarding the growth of already established tumors and prolong the survival of treated mice. Moreover, anti-PSCA v.4 mAbs demonstrate a dramatic inhibitory effect on the spread of local prostate tumor to distal sites, even in the presence of a large tumor burden. Thus, anti-PSCA v.4 mAbs are efficacious on major clinically relevant end points (tumor growth), prolongation of survival, and health.

Example 39

Therapeutic and Diagnostic use of Anti-PSCA Antibodies in Humans

Anti-PSCA monoclonal antibodies are safely and effectively used for diagnostic, prophylactic, prognostic and/or therapeutic purposes in humans. Western blot and immunohistochemical analysis of cancer tissues and cancer xenografts with anti-PSCA mAb show strong extensive staining in carcinoma but significantly lower or undetectable levels in normal tissues. Detection of PSCA in carcinoma and in metastatic disease demonstrates the usefulness of the mAb as a diagnostic and/or prognostic indicator. Anti-PSCA antibodies are therefore used in diagnostic applications such as immunohistochemistry of kidney biopsy specimens to detect cancer from suspect patients.

As determined by flow cytometry, anti-PSCA mAb specifically binds to carcinoma cells. Thus, anti-PSCA antibodies are used in diagnostic whole body imaging applications, such as radioimmunoscintigraphy and radioimmunotherapy, (see, e.g., Potamianos S., et. al. Anticancer Res 20(2A):925-948 (2000)) for the detection of localized and metastatic cancers that exhibit expression of PSCA. Shedding or release of an extracellular domain of PSCA into the extracellular milieu, such as that seen for alkaline phosphodiesterase B10 (Meerson, N. R., Hepatology 27:563-568 (1998)), allows diagnostic detection of PSCA by anti-PSCA antibodies in serum and/or urine samples from suspect patients.

Anti-PSCA antibodies that specifically bind PSCA are used in therapeutic applications for the treatment of cancers that express PSCA. Anti-PSCA antibodies are used as an unconjugated modality and as conjugated form in which the antibodies are attached to one of various therapeutic or imaging modalities well known in the art, such as a prodrugs, enzymes or radioisotopes. In preclinical studies, unconjugated and conjugated anti-PSCA antibodies are tested for efficacy of tumor prevention and growth inhibition in the SCID mouse cancer xenograft models, e.g., kidney cancer models AGS-K3 and AGS-K6, (see, e.g., the Example entitled "PSCA Monoclonal Antibody-mediated Inhibition of Bladder and Lung Tumors In Vivo"). Either conjugated and unconjugated anti-PSCA antibodies are used as a therapeutic modality in human clinical trials either alone or in combination with other treatments as described in following Examples.

Example 40

Human Clinical Trials for the Treatment and Diagnosis of Human Carcinomas Through use of Human Anti-PSCA Antibodies In vivo Antibodies are used in accordance with the present invention which recognize an epitope on PSCA, and are used in the treatment of certain tumors such as those listed in Table I. Based upon a number of factors, including PSCA expression levels, tumors such as those listed in Table I are presently preferred indications. In connection with each of these indications, three clinical approaches are successfully pursued.

I.) Adjunctive therapy: In adjunctive therapy, patients are treated with anti-PSCA antibodies in combination with a chemotherapeutic or antineoplastic agent and/or radiation therapy. Primary cancer targets, such as those listed in Table I, are treated under standard protocols by the addition anti-PSCA antibodies to standard first and second line therapy. Protocol designs address effectiveness as assessed by reduction in tumor mass as well as the ability to reduce usual doses of standard chemotherapy. These dosage reductions allow additional and/or prolonged therapy by reducing dose-related toxicity of the chemotherapeutic agent. Anti-PSCA antibodies are utilized in several adjunctive clinical trials in combination with the chemotherapeutic or antineoplastic agents adriamycin (advanced prostate carcinoma), cisplatin (advanced head and neck and lung carcinomas), taxol (breast cancer), and doxorubicin (preclinical).

II.) Monotherapy: In connection with the use of the anti-PSCA antibodies in monotherapy of tumors, the antibodies are administered to patients without a chemotherapeutic or antineoplastic agent. In one embodiment, monotherapy is conducted clinically in end stage cancer patients with extensive metastatic disease. Patients show some disease stabilization. Trials demonstrate an effect in refractory patients with cancerous tumors.

III.) Imaging Agent: Through binding a radionuclide (e.g., iodine or yttrium ($I^{131}$, $Y^{90}$) to anti-PSCA antibodies, the radiolabeled antibodies are utilized as a diagnostic and/or imaging agent. In such a role, the labeled antibodies localize to both solid tumors, as well as, metastatic lesions of cells expressing PSCA. In connection with the use of the anti-PSCA antibodies as imaging agents, the antibodies are used as an adjunct to surgical treatment of solid tumors, as both a pre-surgical screen as well as a post-operative follow-up to determine what tumor remains and/or returns. In one embodiment, a ($^{111}$In)-PSCA antibody is used as an imaging agent in a Phase I human clinical trial in patients having a carcinoma that expresses PSCA (by analogy see, e.g., Divgi et al. *J. Natl. Cancer Inst.* 83:97-104 (1991)). Patients are followed with standard anterior and posterior gamma camera. The results indicate that primary lesions and metastatic lesions are identified.

Dose and Route of Administration

As appreciated by those of ordinary skill in the art, dosing considerations can be determined through comparison with the analogous products that are in the clinic. Thus, anti-PSCA antibodies can be administered with doses in the range of 5 to 400 mg/m$^2$, with the lower doses used, e.g., in connection with safety studies. The affinity of anti-PSCA antibodies relative to the affinity of a known antibody for its target is one parameter used by those of skill in the art for determining analogous dose regimens. Further, anti-PSCA antibodies that are fully human antibodies, as compared to the chimeric antibody, have slower clearance; accordingly, dosing in patients with such fully human anti-PSCA antibodies can be lower, perhaps in the range of 50 to 300 mg/m$^2$, and still remain efficacious. Dosing in mg/m$^2$, as opposed to the conventional measurement of dose in mg/kg, is a measurement based on surface area and is a convenient dosing measurement that is designed to include patients of all sizes from infants to adults.

Three distinct delivery approaches are useful for delivery of anti-PSCA antibodies. Conventional intravenous delivery is one standard delivery technique for many tumors. However, in connection with tumors in the peritoneal cavity, such as tumors of the ovaries, biliary duct, other ducts, and the like, intraperitoneal administration may prove favorable for obtaining high dose of antibody at the tumor and to also minimize antibody clearance. In a similar manner, certain solid tumors possess vasculature that is appropriate for regional perfusion. Regional perfusion allows for a high dose of antibody at the site of a tumor and minimizes short term clearance of the antibody.

Clinical Development Plan (CDP)

Overview: The CDP follows and develops treatments of anti-PSCA antibodies in connection with adjunctive therapy, monotherapy, and as an imaging agent. Trials initially demonstrate safety and thereafter confirm efficacy in repeat doses. Trails are open label comparing standard chemotherapy with standard therapy plus anti-PSCA antibodies. As will be appreciated, one criteria that can be utilized in connection with enrollment of patients is PSCA expression levels in their tumors as determined by biopsy.

As with any protein or antibody infusion-based therapeutic, safety concerns are related primarily to (i) cytokine release syndrome, i.e., hypotension, fever, shaking, chills; (ii) the development of an immunogenic response to the material (i.e., development of human antibodies by the patient to the antibody therapeutic, or HAHA response); and, (iii) toxicity to normal cells that express PSCA. Standard tests and follow-up are utilized to monitor each of these safety concerns. Anti-PSCA antibodies are found to be safe upon human administration.

Example 41

Human Clinical Trial Adjunctive Therapy with Human Anti-PSCA Antibody and Chemotherapeutic Agent A phase I human clinical trial is initiated to assess the safety of six intravenous doses of a human anti-PSCA antibody in connection with the treatment of a solid tumor, e.g., a cancer of a tissue listed in Table I. In the study, the safety of single doses of anti-PSCA antibodies when utilized as an adjunctive therapy to an antineoplastic or chemotherapeutic agent as defined herein, such as, without limitation: cisplatin, topotecan, doxorubicin, adriamycin, taxol, or the like, is assessed. The trial design includes delivery of six single doses of an anti-PSCA antibody with dosage of antibody escalating from approximately about 25 mg/m$^2$ to about 275 mg/m$^2$ over the course of the treatment in accordance with the following schedule:

|  | Day 0 | Day 7 | Day 14 | Day 21 | Day 28 | Day 35 |
|---|---|---|---|---|---|---|
| mAb Dose | 25 mg/m$^2$ | 75 mg/m$^2$ | 125 mg/m$^2$ | 175 mg/m$^2$ | 225 mg/m$^2$ | 275 mg/m$^2$ |
| Chemotherapy (standard dose) | + | + | + | + | + | + |

Patients are closely followed for one-week following each administration of antibody and chemotherapy. In particular, patients are assessed for the safety concerns mentioned above: (i) cytokine release syndrome, i.e., hypotension, fever, shaking, chills; (ii) the development of an immunogenic response to the material (i.e., development of human antibodies by the patient to the human antibody therapeutic, or HAHA response); and, (iii) toxicity to normal cells that express PSCA. Standard tests and follow-up are utilized to monitor each of these safety concerns. Patients are also assessed for clinical outcome, and particularly reduction in tumor mass as evidenced by MRI or other imaging.

The anti-PSCA antibodies are demonstrated to be safe and efficacious, Phase II trials confirm the efficacy and refine optimum dosing.

Example 42

Human Clinical Trial: Monotherapy with Human Anti-PSCA Antibody

Anti-PSCA antibodies are safe in connection with the above-discussed adjunctive trial, a Phase II human clinical trial confirms the efficacy and optimum dosing for monotherapy. Such trial is accomplished, and entails the same safety and outcome analyses, to the above-described adjunctive trial with the exception being that patients do not receive chemotherapy concurrently with the receipt of doses of anti-PSCA antibodies.

Example 43

Human Clinical Trial: Diagnostic Imaging with Anti-PSCA Antibody

Once again, as the adjunctive therapy discussed above is safe within the safety criteria discussed above, a human clinical trial is conducted concerning the use of anti-PSCA antibodies as a diagnostic imaging agent. The protocol is designed in a substantially similar manner to those described in the art, such as in Divgi et al. *J. Natl. Cancer Inst.* 83:97-104 (1991). The antibodies are found to be both safe and efficacious when used as a diagnostic modality.

Example 44

Homology Comparison of PSCA v.4 to Known Sequences

The PSCA v.4 gene encodes a 189 aa protein. The human PSCA v.4 protein exhibit a high degree of homology to human prostate stem cell antigen (gi 27482160), exhibiting 98% identity to PSCA v.4 at the protein level (FIG. 4). The mouse homolog of PSCA v.4 has not been identified.

The PSCA v.4 protein has several variants (FIG. 11). These include 8 SNPs and a splice variant, referred to as PSCA v.3. The PSCA v.3 protein encompasses the C-termial portion of PSCA v.4, and corresponds to aa 94-189 of that variant. Bioinformatics analysis using topology prediction programs indicate that PSCA v.4 is a soluble protein with no transmembrane domains (Table L).

Motif analysis revealed the presence of two protein functional motifs in the PSCA v.4 protein (Table L), namely a cadherin motif and a granulin domain have been identified. Cadherins belong to a family of calcium-dependent cell adhesion molecules. They are single transmembrane proteins containing immunoglobulin like domains, and are involved in cell adhesion and sorting (Shan et al, Biophys Chem 1999, 82:157). For examples, cadherins mediate tissue-specific cell adhesion of lymphocytes to the surface of epithelial cells. Cadherins have been shown to function in tissue morphogenesis, cell adhesion, cell differentiation, cell migration and tumour metastasis (Yap A S, Kovacs E M. J Biol Chem 2003, 160:11; Vestweber D. Curr Opin Cell Biol 2002, 14:587; Bloom et al, Mol Biol Cell. 1999, 10:1521; Brodt P. Cancer Met Rev 1991, 10:23). Granulins or epithelins are growth factors originally purified from cell-conditioned media, shown to enhance cell proliferation (Xu, S. Q. et al, J. Biol. Chem. 1998, 273:20078). Granulins are expressed at elevated levels in several cancers, including gliomas and renal cancer (Liau L et al, Cancer Res. 60:1353, Donald, C. D et al, Anticancer Res. 21:3739).

The motifs found in PSCA v.4 indicate that PSCA v.4 can participate in tumor growth, and progression by regulating cell proliferation, cell adhesion, cell communication, invasion and metastasis.

Accordingly, when PSCA v.4 functions as a regulator of tumor establishment, tumor growth, tumor invasion, survival or cell signaling, PSCA v.4 is used for therapeutic, diagnostic, prognostic and/or preventative purposes. In addition, when a molecule, such as a splice variant or SNP of PSCA v.4 is expressed in cancerous tissues, such as those listed in Table I, they are used for therapeutic, diagnostic, prognostic and/or preventative purposes.

Example 45

Regulation of Transcription

The mitochondrial localization of PSCA v.4 coupled to the presence of cadherin domains within its sequence indicates that PSCA v.4 modulates the transcriptional regulation of eukaryotic genes. Regulation of gene expression is confirmed, e.g., by studying gene expression in cells expressing or lacking PSCA v.4. For this purpose, two types of experiments are performed.

In the first set of experiments, RNA from parental and PSCA v.4-expressing cells are extracted and hybridized to commercially available gene arrays (Clontech) (Smid-Koopman E et al. Br J Cancer. 2000. 83:246). Resting cells as well as cells treated with FBS, androgen or growth factors are compared. Differentially expressed genes are identified in accordance with procedures known in the art. The differentially expressed genes are then mapped to biological pathways (Chen K et al. Thyroid. 2001. 11:41.).

In the second set of experiments, specific transcriptional pathway activation is evaluated using commercially available (Stratagene) luciferase reporter constructs including: NFkB-luc, SRE-luc, ELK1-luc, ARE-luc, p53-luc, and CRE-luc. These transcriptional reporters contain consensus binding sites for known transcription factors that lie downstream of well-characterized signal transduction pathways, and represent a good tool to ascertain pathway activation and screen for positive and negative modulators of pathway activation.

Thus, PSCA v.4 plays a role in gene regulation, and it is used as a target for diagnostic, prognostic, preventative and/or therapeutic purposes.

Example 46

Identification and Confirmation of Potential Signal Transduction Pathways

Many mammalian proteins have been reported to interact with signaling molecules and to participate in regulating signaling pathways. (J Neurochem. 2001; 76:217-223). Cadherin molecules have been associated with Cdc42 and Rho signaling (Kouklis J Biol Chem. 2003, 278: 16230). Using immunoprecipitation and Western blotting techniques, proteins are identified that associate with PSCA v.4 and mediate signaling events. Several pathways known to play a role in cancer biology can be regulated by PSCA v.4, including phospholipid pathways such as PI3K, AKT, etc, adhesion and migration pathways, including FAK, Rho, Rac-1, catenin, etc, as well as mitogenic/survival cascades such as ERK, p38, etc (Cell Growth Differ. 2000,11:279; J Biol Chem. 1999, 274:801; Oncogene. 2000, 19:3003, J. Cell Biol. 1997, 138: 913.).). In order to determine whether expression of PSCA v.4 is sufficient to regulate specific signaling pathways not otherwise active in resting cancer cells, the effect of PSCA v.4 on the activation of the signaling cascade is investigated in the cancer cell lines PA-1, Panc1 and Daudi. Cancer cells stably expressing PSCA v.4 or neo are stimulated with growth factor, FBS or other activating molecules. Whole cell lysates are analyzed by western blotting.

To confirm that PSCA v.4 directly or indirectly activates known signal transduction pathways in cells, luciferase (luc) based transcriptional reporter assays are carried out in cells expressing individual genes. These transcriptional reporters contain consensus-binding sites for known transcription factors that lie downstream of well-characterized signal transduction pathways. The reporters and examples of these associated transcription factors, signal transduction pathways, and activation stimuli are listed below.

1. NFkB-luc, NFkB/Rel; Ik-kinase/SAPK; growth/apoptosis/stress
2. SRE-luc, SRF/TCF/ELK1; MAPK/SAPK; growth/differentiation
3. AP-1-luc, FOS/JUN; MAPK/SAPK/PKC; growth/apoptosis/stress
4. ARE-luc, androgen receptor; steroids/MAPK; growth/differentiation/apoptosis
5. p53-luc, p53; SAPK; growth/differentiation/apoptosis
6. CRE-luc, CREB/ATF2; PKA/p38; growth/apoptosis/stress
7. TCF-luc, TCF/Lef; β-catenin, Adhesion/invasion Gene-mediated effects can be assayed in cells showing mRNA expression. Luciferase reporter plasmids can be introduced by lipid-mediated transfection (TFX-50, Promega). Luciferase activity, an indicator of relative transcriptional activity, is measured by incubation of cell extracts with luciferin substrate and luminescence of the reaction is monitored in a luminometer.

Signaling pathways activated by PSCA v.4 are mapped and used for the identification and validation of therapeutic targets. When PSCA v.4 is involved in cell signaling, it is used as target for diagnostic, prognostic, preventative and/or therapeutic purposes.

Example 47

Involvement in Tumor Progression

Based on the role of granulin and cadherin motifs in cell growth, adhesion and protein interactions, the PSCA v.4 gene can contribute to the growth, adhesion, invasion and transformation of cancer cells. The role of PSCA v.4 in tumor growth is confirmed in a variety of primary and transfected cell lines including prostate cell lines, as well as NIH 3T3 cells engineered to stably express PSCA v.4. Parental cells lacking PSCA v.4 and cells expressing PSCA v.4 are evaluated for cell growth using a well-documented proliferation assay (Fraser S P, Grimes J A, Djamgoz M B. Prostate. 2000;44:61, Johnson D E, Ochieng J, Evans S L. Anticancer Drugs. 1996, 7:288).

To confirm the role of PSCA v.4 in the transformation process, its effect in colony forming assays is investigated.

Parental NIH-3T3 cells lacking PSCA v.4 are compared to NIH-3T3 cells expressing PSCA v.4, using a soft agar assay under stringent and more permissive conditions (Song Z. et al. Cancer Res. 2000;60:6730).

To confirm the role of PSCA v.4 in invasion and metastasis of cancer cells, a well-established assay is used, e.g., a Transwell Insert System assay (Becton Dickinson) (Cancer Res. 1999; 59:6010). Control cells, including prostate, pancreas and kidney cell lines lacking PSCA v.4 are compared to cells expressing PSCA v.4. Cells are loaded with the fluorescent dye, calcein, and plated in the top well of the Transwell insert coated with a basement membrane analog. Invasion is determined by fluorescence of cells in the lower chamber relative to the fluorescence of the entire cell population.

PSCA v.4 can also play a role in cell cycle and apoptosis. Parental cells and cells expressing PSCA v.4 are compared for differences in cell cycle regulation using a well-established BrdU assay (Abdel-Malek Z A. J Cell Physiol. 1988, 136: 247). In short, cells are grown under both optimal (full serum) and limiting (low serum) conditions are labeled with BrdU and stained with anti-BrdU Ab and propidium iodide. Cells are analyzed for entry into the G1, S, and G2M phases of the cell cycle. Alternatively, the effect of stress on apoptosis is evaluated in control parental cells and cells expressing PSCA v.4, including normal and tumor prostate cells. Engineered and parental cells are treated with various chemotherapeutic agents, such as etoposide, taxol, etc, and protein synthesis inhibitors, such as cycloheximide. Cells are stained with annexin V-FITC and cell death is measured by FACS analysis. The modulation of cell death by PSCA v.4 can play a critical role in regulating tumor progression and tumor load.

When PSCA v.4 plays a role in cell growth, transformation, invasion or apoptosis, it is used as a target for diagnostic, prognostic, preventative and/or therapeutic purposes.

Example 48

Involvement in Angiogenesis

Angiogenesis or new capillary blood vessel formation is necessary for tumor growth (Hanahan D, Folkman J. Cell. 1996, 86:353; Folkman J. Endocrinology. 1998 139:441). Several assays have been developed to measure angiogenesis in vitro and in vivo, such as the tissue culture assays endothelial cell tube formation and endothelial cell proliferation. Using these assays as well as in vitro neo-vascularization, the role of PSCA v.4 in angiogenesis, enhancement or inhibition, is confirmed.

For example, endothelial cells engineered to express PSCA v.4 are evaluated using tube formation and proliferation assays. The effect of PSCA v.4 is also confirmed in animal models in vivo. For example, cells either expressing or lacking PSCA v.4 are implanted subcutaneously in immunocompromised mice. Endothelial cell migration and angiogenesis are evaluated 5-15 days later using immunohistochemistry techniques. PSCA v.4 affects angiogenesis, and it is used as a target for diagnostic, prognostic, preventative and/or therapeutic purposes.

Example 49

Involvement in Protein-Protein Interactions

Cadhesrin motifs have been shown to mediate interaction with other proteins. Using immunoprecipitation techniques as well as two yeast hybrid systems, proteins are identified that associate with PSCA v.4. Immunoprecipitates from cells expressing PSCA v.4 and cells lacking PSCA v.4 are compared for specific protein-protein associations.

Studies are performed to confirm the extent of association of PSCA v.4 with effector molecules, such as nuclear proteins, transcription factors, kinases, phosphates etc. Studies comparing PSCA v.4 positive and PSCA v.4 negative cells as well as studies comparing unstimulated/resting cells and cells treated with epithelial cell activators, such as cytokines, growth factors, androgen and anti-integrin Ab reveal unique interactions.

In addition, protein-protein interactions are confirmed using two yeast hybrid methodology (Curr Opin Chem Biol. 1999, 3:64). A vector carrying a library of proteins fused to the activation domain of a transcription factor is introduced into yeast expressing a PSCA v.4-DNA-binding domain fusion protein and a reporter construct. Protein-protein interaction is detected by colorimetric reporter activity. Specific association with effector molecules and transcription factors directs one of skill to the mode of action of PSCA v.4, and thus identifies therapeutic, prognostic, preventative and/or diagnostic targets for cancer. This and similar assays are also used to identify and screen for small molecules that interact with PSCA v.4.

Thus it is found that PSCA v.4 associates with proteins and small molecules. Accordingly, PSCA v.4 and these proteins and small molecules are used for diagnostic, prognostic, preventative and/or therapeutic purposes.

Example 50

Involvement of PSCA v.4 in Cell-cell Communication

Cell-cell communication is essential in maintaining organ integrity and homeostasis, both of which become deregulated during tumor formation and progression. Based on the presence of a cadhesrin motif in PSCA v.4, a motif known to be involved in cell interaction and cell-cell adhesion, PSCA v.4 can regulate cell communication. Intercellular communications can be measured using two types of assays (J. Biol. Chem. 2000, 275:25207). In the first assay, cells loaded with a fluorescent dye are incubated in the presence of unlabeled recipient cells and the cell populations are examined under fluorescent microscopy. This qualitative assay measures the exchange of dye between adjacent cells. In the second assay system, donor and recipient cell populations are treated as above and quantitative measurements of the recipient cell population are performed by FACS analysis. Using these two assay systems, cells expressing PSCA v.4 are compared to controls that do not express PSCA v.4, and it is found that PSCA v.4 enhances cell communications. Small molecules and/or antibodies that modulate cell-cell communication mediated by PSCA v.4 are used as therapeutics for cancers that express PSCA v.4. When PSCA v.4 functions in cell-cell communication and small molecule transport, it is used as a target or marker for diagnostic, prognostic, preventative and/or therapeutic purposes.

Throughout this application, various website data content, publications, patent applications, and patents are referenced. (Websites are referenced by their Uniform Resource Locator, or URL, addresses on the World Wide Web.) The disclosures of each of these references are hereby incorporated by reference herein in their entireties. In addition, this application relates to U.S. Ser. No. 09/359,326, filed Jul. 20, 1999; U.S. Ser. No. 09/308,503, filed May 25, 1999; U.S. Ser. No. 09/251,835, filed Feb. 17, 1999; U.S. Ser. No. 09/203,939, filed Dec. 2, 1998; U.S. Ser. No. 09/038,261, filed Mar. 10, 1998; U.S. Ser. No. 08/814,279, filed Mar. 10, 1997; U.S. Ser. No. 60/071,141 filed Jan. 12, 1998; U.S. Ser. No. 60/074,675, filed Feb. 13, 1998; U.S. Ser. No. 60/124,658, filed Mar. 16, 1999; U.S. Ser. Nos. 60/120,536 filed Feb. 17, 1999; and 60/113,230 filed Dec. 21, 1998. The contents of all of the foregoing applications are fully incorporated by reference into the present application.

The present invention is not to be limited in scope by the embodiments disclosed herein, which are intended as single illustrations of individual aspects of the invention, and any that are functionally equivalent are within the scope of the invention. Various modifications to the models and methods of the invention, in addition to those described herein, will become apparent to those skilled in the art from the foregoing description and teachings, and are similarly intended to fall within the scope of the invention. Such modifications or other embodiments can be practiced without departing from the true scope and spirit of the invention.

TABLES

TABLE I

Tissues that Express PSCA:

a. Malignant Tissues
  Prostate
  Pancreas
  Bladder
  Kidney
  Colon
  Lung

TABLE I-continued

Tissues that Express PSCA:

Ovary
  Breast
b. Normal Tissues

TABLE II

Amino Acid Abbreviations

| SINGLE LETTER | THREE LETTER | FULL NAME |
|---|---|---|
| F | Phe | phenylalanine |
| L | Leu | leucine |
| S | Ser | serine |
| Y | Tyr | tyrosine |
| C | Cys | cysteine |
| W | Trp | tryptophan |
| P | Pro | proline |
| H | His | histidine |
| Q | Gln | glutamine |
| R | Arg | arginine |
| I | Ile | isoleucine |
| M | Met | methionine |
| T | Thr | threonine |
| N | Asn | asparagine |
| K | Lys | lysine |
| V | Val | valine |
| A | Ala | alanine |
| D | Asp | aspartic acid |
| E | Glu | glutamic acid |
| G | Gly | glycine |

TABLE III

Amino Acid Substitution Matrix
Adapted from the GCG Software 9.0 BLOSUM62 amino acid substitution matrix (block substitution matrix). The higher the value, the more likely a substitution is found in related, natural proteins.
(See world wide web URL ikp.unibe.ch/manual/blosum62.html)

| A | C | D | E | F | G | H | I | K | L | M | N | P | Q | R | S | T | V | W | Y | . |
|---|---|---|---|---|---|---|---|---|---|---|---|---|---|---|---|---|---|---|---|---|
| 4 | 0 | -2 | -1 | -2 | 0 | -2 | -1 | -1 | -1 | -1 | -2 | -1 | -1 | -1 | 1 | 0 | 0 | -3 | -2 | A |
|  | 9 | -3 | -4 | -2 | -3 | -3 | -1 | -3 | -1 | -1 | -3 | -3 | -3 | -3 | -1 | -1 | -1 | -2 | -2 | C |
|  |  | 6 | 2 | -3 | -1 | -1 | -3 | -1 | -4 | -3 | 1 | -1 | 0 | -2 | 0 | -1 | -3 | -4 | -3 | D |
|  |  |  | 5 | -3 | -2 | 0 | -3 | 1 | -3 | -2 | 0 | -1 | 2 | 0 | 0 | -1 | -2 | -3 | -2 | E |
|  |  |  |  | 6 | -3 | -1 | 0 | -3 | 0 | 0 | -3 | -4 | -3 | -3 | -2 | -2 | -1 | 1 | 3 | F |
|  |  |  |  |  | 6 | -2 | -4 | -2 | -4 | -3 | 0 | -2 | -2 | -2 | 0 | -2 | -3 | -2 | -3 | G |
|  |  |  |  |  |  | 8 | -3 | -1 | -3 | -2 | 1 | -2 | 0 | 0 | -1 | -2 | -3 | -2 | 2 | H |
|  |  |  |  |  |  |  | 4 | -3 | 2 | 1 | -3 | -3 | -3 | -3 | -2 | -1 | 3 | -3 | -1 | I |
|  |  |  |  |  |  |  |  | 5 | -2 | -1 | 0 | -1 | 1 | 2 | 0 | -1 | -2 | -3 | -2 | K |
|  |  |  |  |  |  |  |  |  | 4 | 2 | -3 | -3 | -2 | -2 | -2 | -1 | 1 | -2 | -1 | L |
|  |  |  |  |  |  |  |  |  |  | 5 | -2 | -2 | 0 | -1 | -1 | -1 | 1 | -1 | -1 | M |
|  |  |  |  |  |  |  |  |  |  |  | 6 | -2 | 0 | 0 | 1 | 0 | -3 | -4 | -2 | N |
|  |  |  |  |  |  |  |  |  |  |  |  | 7 | -1 | -2 | -1 | -1 | -2 | -4 | -3 | P |
|  |  |  |  |  |  |  |  |  |  |  |  |  | 5 | 1 | 0 | -1 | -2 | -2 | -1 | Q |
|  |  |  |  |  |  |  |  |  |  |  |  |  |  | 5 | -1 | -1 | -3 | -3 | -2 | R |
|  |  |  |  |  |  |  |  |  |  |  |  |  |  |  | 4 | 1 | -2 | -3 | -2 | S |
|  |  |  |  |  |  |  |  |  |  |  |  |  |  |  |  | 5 | 0 | -2 | -2 | T |
|  |  |  |  |  |  |  |  |  |  |  |  |  |  |  |  |  | 4 | -3 | -1 | V |
|  |  |  |  |  |  |  |  |  |  |  |  |  |  |  |  |  |  | 11 | 2 | W |
|  |  |  |  |  |  |  |  |  |  |  |  |  |  |  |  |  |  |  | 7 | Y |

TABLE IV

HLA Class I/II Motifs/Supermotifs

TABLE IV (A)

| | HLA Class I Supermotifs/Motifs | | |
|---|---|---|---|
| | POSITION 2 (Primary Anchor) | POSITION 3 (Primary Anchor) | POSITION C Terminus (Primary Anchor) |
| SUPERMOTIF | | | |
| A1 | T*ILVMS* (SEQ ID NO:5) | | FWY |
| A2 | LIVM*ATQ* (SEQ ID NO:6) | | IVM*ATL* (SEQ ID NO:18) |
| A3 | VSMA*TLI* (SEQ ID NO:7) | | RK |
| A24 | YF*WIVLMT* (SEQ ID NO:8) | | FI*YWLM* (SEQ ID NO:19) |
| B7 | P | | VILF*MWYA* (SEQ ID NO:20) |
| B27 | RHK | | FYL*WMIVA* (SEQ ID NO:21) |
| B44 | E*D* | | FWYLIMVA (SEQ ID NO:22) |
| B58 | ATS | | FWY*LIVMA* (SEQ ID NO:23) |
| B62 | QL*IVMP* (SEQ ID NO:9) | | FWY*MIVLA* (SEQ ID NO:24) |
| MOTIFS | | | |
| A1 | TSM | | Y |
| A1 | | DE*AS* (SEQ ID NO:17) | Y |
| A2.1 | LM*VQIAT* (SEQ ID NO:10) | | V*LIMAT* (SEQ ID NO:25) |
| A3 | LMVISATF*CGD* (SEQ ID NO:11) | | KYR*HFA* (SEQ ID NO:16) |
| A11 | VTMLISAGN*CDF* (SEQ ID NO:12) | | K*RYH* (SEQ ID NO:27) |
| A24 | YF*WM* (SEQ ID NO:13) | | FLIW (SEQ ID NO:28) |
| A*3101 | MVT*ALIS* (SEQ ID NO:14) | | R*K* |
| A*3301 | MVALF*IST* (SEQ ID NO:15) | | RK |
| A*6801 | AVT*MSLI* (SEQ ID NO:16) | | RK |
| B*0702 | P | | LMF*WYAIV* (SEQ ID NO:29) |
| B*3501 | P | | LMFWY*IVA* (SEQ ID NO:30) |
| B51 | P | | LIVF*WYAM* (SEQ ID NO:31) |
| B*5301 | P | | IMFWY*ALV* (SEQ ID NO:32) |
| B*5401 | P | | ATIV*LMFWY* (SEQ ID NO:33) |

Bolded residues are preferred, italicized residues are less preferred: A peptide is considered motif-bearing if it has primary anchors at each primary anchor position for a motif or supermotif as specified in the above table.

TABLE IV (B)

| HLA Class II Supermotif | | |
|---|---|---|
| 1 | 6 | 9 |
| W, F, Y, V, .I, L | A, V, I, L, P, C, S, T | A, V, I, L, C, S, T, M, Y |

TABLE IV (C)

| | HLA Class II Motifs | | | | | | | | |
|---|---|---|---|---|---|---|---|---|---|
| MOTIFS | | 1° anchor 1 | 2 | 3 | 4 | 5 | 1° anchor 6 | 7 | 8 9 |
| DR4 | preferred | FMY*LIVW* (SEQ ID NO:34) | M | T | | I | VST*CPALIM* (SEQ ID NO: 35) | MH | MH |
| | deleterious | | | | W | | | R | WDE |
| DR1 | preferred | MF*LIVWY* (SEQ ID NO:36) | | PAMQ (SEQ ID NO: 37) | | | VMAT*SPLIC* (SEQ ID NO:38) | M | AVM |
| | deleterious | | C | CH | FD | | CWD | GDE | D |
| DR7 | preferred | MF*LIVWY* (SEQ ID NO:39) | M | W | A | | IVMSA*CTPL* (SEQ ID NO: 40) | M | IV |
| | deleterious | | C | | G | | | GRD | N G |

| DR3 | MOTIFS | 1° anchor 1 | 2 | 3 | 1° anchor 4 | 5 | 1° anchor 6 |
|---|---|---|---|---|---|---|---|
| Motif a preferred | | LIVMFY (SEQ ID NO:41) | | | D | | |
| Motif b preferred | | LIVMFAY (SEQ ID NO:42) | | | DNQEST (SEQ ID NO: 43) | | KRH |
| DR Supermotif | | MF*LIVWY* (SEQ ID NO:44) | | | | | VMSTA*CPLI* (SEQ OD NO:45) |

Italicized residues indicate less preferred or "tolerated" residues

TABLE IV (D)

HLA Class I Supermotifs

| SUPER-MOTIFS | | 1 | 2 | 3 | 4 | 5 | 6 | 7 | 8 | C-terminus |
|---|---|---|---|---|---|---|---|---|---|---|
| A1 | | | 1° Anchor TI*LVMS* (SEQ ID NO:46) | | | | | | | 1° Anchor FWY |
| A2 | | | 1° Anchor LIVM*ATQ* (SEQ ID NO:47) | | | | | | | 1° Anchor LIVMAT (SEQ ID NO: 48) |
| A3 | Preferred | | 1° Anchor VSMA*TLI* (SEQ ID NO:49) | YFW (4/5) | | YFW (3/5) | YFW (4/5) | P (4/5) | | 1° Anchor RK |
|  | deleterious | DE(3/5); P(5/5) | | DE (4/5) | | | | | | |
| A24 | | | 1° Anchor YF*WIVLMT* (SEQ ID NO:50) | | | | | | | 1° Anchor FIY*WLM* (SEQ ID NO: 51) |
| B7 | Preferred | FWY(5/5) LIVM(3/5) | 1° Anchor P | FWY (4/5) | | | | | FWY (3/5) | 1° Anchor VILF*MWYA* (SEQ ID NO: 52) |
|  | deleterious | DE(3/5); P(5/5); G(4/5); A(3/5); QN(3/5) | | | | DE (3/5) | G (4/5) | QN (4/5) | DE (4/5) | |
| B27 | | | 1° Anchor RHK | | | | | | | 1° Anchor FYL*WMIVA* (SEQ ID NO: 53) |
| B44 | | | 1° Anchor E*D* | | | | | | | 1° Anchor FWYLIMVA (SEQ ID NO: 54) |
| B58 | | | 1° Anchor ATS | | | | | | | 1° Anchor FWY*LIVMA* (SEQ ID NO: 55) |
| B62 | | | 1° Anchor QL*IVMP* (SEQ ID NO:56) | | | | | | | 1° Anchor FWY*MIVLA* (SEQ ID NO: 57) |

Italicized residues indicate less preferred or "tolerated" residues

TABLE IV (E)

HLA Class I Motifs

| | | POSITION | | | | | | | | | |
|---|---|---|---|---|---|---|---|---|---|---|---|
| | | 1 | 2 | 3 | 4 | 5 | 6 | 7 | 8 | 9 or C-terminus | C-terminus |
| A1 9-mer | preferred | GFYW (SEQ ID NO: 58) | 1° Anchor STM | DEA | YFW | | P | DEQN (SEQ ID NO: 109) | YFW | 1° Anchor Y | |
| | deleterious | DE | | RHKLIVMP (SEQ ID NO:59) | A | G | A | | | | |
| A1 9-mer | preferred | GRHK (SEQ ID NO: 60) | ASTCLIVM (SEQ ID NO: 61) | 1° Anchor DE*AS* (SEQ ID NO:72) | GSTC (SEQ ID NO: 62) | | ASTC (SEQ ID NO: 63) | LIVM (SEQ ID NO: 64) | DE | 1° Anchor Y | |
| | deleterious | A | RHKDEPYFW (SEQ ID NO:65) | | DE | PQN | RHK | PG | GP | | |
| A1 10-mer | preferred | YFW | 1° Anchor STM | DEAQN (SEQ ID | A | YFWQN (SEQ | | PASTC | GDE | P | 1° Anchor Y |

TABLE IV (E)-continued

HLA Class I Motifs

|  |  | 1 | 2 | 3 | 4 | 5 | 6 | 7 | 8 | 9 | C-Terminus |
|---|---|---|---|---|---|---|---|---|---|---|---|
|  | deleterious | GP |  | RHKGLIVM (SEQ ID NO:69) | DE | NO:66) RHK | ID NO: 67) QNA | NO: 68) RHKYFW (SEQ ID NO:70) | RHK | A |  |
| A1 10-mer | preferred | YFW | STCLIVM (SEQ ID NO:71) | 1° Anchor DE*AS* (SEQ ID NO:72) | A | YFW |  | PG | G | YFW | 1° Anchor Y |
|  | deleterious | RHK | RHKDEPYFW (SEQ ID NO:73) |  |  | P | G |  | PRHK (SEQ ID NO: 74) | QN |  |
| A2.1 9-mer | preferred | YFW | 1°Anchor LM*IVQAT* (SEQ ID NO:75) | YFW | STC | YFW |  | A | P | 1° Anchor V*LIMAT* (SEQ ID NO:76) |  |
|  | deleterious | DEP |  | DERKH (SEQ ID NO:77) |  |  | RKH | DERKH (SEQ ID NO:77) |  |  |  |
| A2.1 10-mer | preferred | AYFW (SEQ ID NO: 78) | 1°Anchor LM*IVQAT* (SEQ ID NO:79) | LVIM (SEQ ID NO:80) | G |  | G |  | FYWL VIM (SEQ ID NO:81) |  | 1° Anchor V*LIMAT* |
|  | deleterious | DEP |  | DE | RKHA (SEQ ID NO:82) | P |  | RKH | DERKH RKH (SEQ ID NO:83) |  |  |

|  |  | 1 | 2 | 3 | 4 | 5 | 6 | 7 | 8 | 9 | C-Terminus |
|---|---|---|---|---|---|---|---|---|---|---|---|
| A3 | preferred | RHK | 1°Anchor LMVISATFCGD (SEQ ID NO:84) | YFW | PRHKYFW (SEQ ID NO:85) | A | YFW |  | P | 1° Anchor KYR*HFA* (SEQ ID NO:86) |  |
|  | deleterious | DEP |  | DE |  |  |  |  |  |  |  |
| A11 | preferred | A | 1°Anchor VTLMISAGN*CDF* (SEQ ID NO:87) | YFW | YFW | A | YFW | YFW | P | 1° Anchor KR*YH* (SEQ ID NO:88) |  |
|  | deleterious | DEP |  |  |  |  |  | A | G |  |  |
| A24 9-mer | Preferred | YFWRHK (SEQ ID NO:89) | 1° Anchor YFW*M* (SEQ ID NO:90) |  | STC |  |  | YFW | YFW | 1° Anchor FLIW (SEQ ID NO:91) |  |
|  | deleterious | DEG |  | DE | G | QNP | DERHK (SEQ ID NO:92) | G | AQN |  |  |
| A24 10-mer | Preferred |  | 1° Anchor YFW*M* (SEQ ID NO:93) |  | P | YFWP (SEQ ID NO:94) |  | P |  |  | 1° Anchor FLIW (SEQ ID NO:95) |
|  | Deleterious |  |  | GDE | QN | RHK | DE | A | QN | DEA |  |
| A3101 | Preferred | RHK | 1° Anchor MVTA*LIS* (SEQ ID NO:96) | YFW | P |  | YFW | YFW | AP | 1° Anchor R*K* |  |
|  | Deleterious | DEP |  | DE |  | ADE | DE | DE | DE |  |  |
| A3301 | Preferred |  | 1° Anchor MVALF*IST* (SEQ ID NO:97) | YFW |  |  |  | AYFW (SEQ ID NO: 98) |  | 1° Anchor RK |  |
|  | Deleterious | GP |  | DE |  |  |  |  |  |  |  |
| A6801 | Preferred | YFWSTC (SEQ ID NO:99) | 1°Anchor AVT*MSLI* (SEQ ID NO:100) |  |  | YFWLIVM (SEQ ID NO:101) |  | YFW | P | 1° Anchor RK |  |

TABLE IV (E)-continued

HLA Class I Motifs

| | | 1 | 2 | 3 | 4 | 5 | 6 | 7 | 8 | 9 | C-terminus |
|---|---|---|---|---|---|---|---|---|---|---|---|
| | deleterious | GP | | DEG | | RHK | | | A | | |
| B0702 | Preferred | RHKFWY (SEQ ID NO:102) | 1° Anchor P | RHK | | RHK | RHK | RHK | PA | | 1°Anchor LMF*WYAIV* (SEQ ID NO:103) |

| | | POSITION | | | | | | | | | C-terminus |
|---|---|---|---|---|---|---|---|---|---|---|---|
| | | 1 | 2 | 3 | 4 | 5 | 6 | 7 | 8 | 9 | |
| A1 9-mer | preferred | GFYW (SEQ ID NO:58) | 1° Anchor STM | DEA | YFW | | P | DEQN (SEQ ID NO:109) | YFW | 1° Anchor Y | |
| | deleterious | DE | | RHKLIVMP (SEQ ID NO:108) | A | G | A | | | | |
| A1 9-mer | preferred | GRHK (SEQ ID NO:60) | ASTCLIVM (SEQ ID NO:111) | 1° Anchor DE*AS* (SEQ ID NO:112) | GSTC | | ASTC (SEQ ID NO:113) | LIVM (SEQ ID NO:127) | DE | 1° Anchor Y | |
| | deleterious | A | RHKDEPYFW (SEQ ID NO:115) | | DE | PQN | RHK | PG | GP | | |
| B0702 | deleterious | DEQNP (SEQ ID NO:104) | | DEP | DE | DE | GDE | QN | DE | | |
| B3501 | Preferred | FWYLIVM (SEQ ID NO:105) | 1° Anchor P | FWY | | | | FWY | | 1°Anchor LMFWY*IVA* (SEQ ID NO:106) | |
| | deleterious | AGP | | | | G | G | | | | |
| B51 | Preferred | LIVMFWY (SEQ ID NO:121) | 1° Anchor P | FWY | STC | FWY | | G | FWY | 1°Anchor LIVF*WYAM* (SEQ ID NO:117) | |
| | deleterious | AGPDERHKSTC (SEQ ID NO:6557) | | | | DE | G | DEQN (SEQ ID NO:109) | GDE | | |
| B5301 | preferred | LIVMFWY (SEQ ID NO:121) | 1° Anchor P | FWY | STC | FWY | | LIVMFWY (SEQ ID NO:122) | FWY | 1°Anchor IMFWY*ALV* (SEQ ID NO:123) | |
| | deleterious | AGPQN (SEQ ID NO:124) | | | | | G | RHKQN (SEQ ID NO:125) | DE | | |
| B5401 | preferred | FWY | 1° Anchor P | FWYLIVM (SEQ ID NO:126) | LIVM (SEQ ID NO:127) | | ALIVM (SEQ ID NO:128) | FWYAP (SEQ ID NO:129) | | 1°Anchor ATIV*LMFWY* (SEQ ID NO:130) | |
| | deleterious | GPQNDE (SEQ ID NO:131) | | GDESTC (SEQ ID NO:132) | RHKDE (SEQ ID NO:133) | DE | QNDGE (SEQ ID NO:134) | DE | | | |

TABLE IV (F)

Summary of HLA-supertypes
Overall phenotypic frequencies of HLA-supertypes in different ethnic populations

| | Specificity | | Phenotypic frequency | | | | | |
|---|---|---|---|---|---|---|---|---|
| Supertype | Position 2 | C-Terminus | Caucasian | N.A. Black | Japanese | Chinese | Hispanic | Average |
| B7 | P | AILMVFWY (SEQ ID NO: 135) | 43.2 | 55.1 | 57.1 | 43.0 | 49.3 | 49.5 |
| A3 | AILMVST (SEQ ID NO: 136) | RK | 37.5 | 42.1 | 45.8 | 52.7 | 43.1 | 44.2 |

TABLE IV (F)-continued

Summary of HLA-supertypes
Overall phenotypic frequencies of HLA-supertypes in different ethnic populations

| | Specificity | | Phenotypic frequency | | | | | |
|---|---|---|---|---|---|---|---|---|
| Supertype | Position 2 | C-Terminus | Caucasian | N.A. Black | Japanese | Chinese | Hispanic | Average |
| A2 | AILMVT (SEQ ID NO: 137) | AILMVT (SEQ ID NO: 138) | 45.8 | 39.0 | 42.4 | 45.9 | 43.0 | 42.2 |
| A24 | YF (WIVLMT) (SEQ ID NO: 139) | FI (YWLM) (SEQ ID NO: 140) | 23.9 | 38.9 | 58.6 | 40.1 | 38.3 | 40.0 |
| B44 | E (D) | FWYLIMVA (SEQ ID NO: 141) | 43.0 | 21.2 | 42.9 | 39.1 | 39.0 | 37.0 |
| A1 | TI (LVMS) (SEQ ID NO: 142) | FWY | 47.1 | 16.1 | 21.8 | 14.7 | 26.3 | 25.2 |
| B27 | RHK | FYL (WMI) (SEQ ID NO: 143) | 28.4 | 26.1 | 13.3 | 13.9 | 35.3 | 23.4 |
| B62 | QL (IVMP) (SEQ ID NO: 144) | FWY (MIV) (SEQ ID NO: 145) | 12.6 | 4.8 | 36.5 | 25.4 | 11.1 | 18.1 |
| B58 | ATS | FWY (LIV) (SEQ ID NO: 146) | 10.0 | 25.1 | 1.6 | 9.0 | 5.9 | 10.3 |

TABLE IV (G)

Calculated population coverage afforded by different HLA-supertype combinations

| | Phenotypic frequency | | | | | |
|---|---|---|---|---|---|---|
| HLA-supertypes | Caucasian | N.A Blacks | Japanese | Chinese | Hispanic | Average |
| A2, A3 and B7 | 83.0 | 86.1 | 87.5 | 88.4 | 86.3 | 86.2 |
| A2, A3, B7, A24, B44 and A1 | 99.5 | 98.1 | 100.0 | 99.5 | 99.4 | 99.3 |
| A2, A3, B7, A24 B44, A1, B27, B62, and B58 | 99.9 | 99.6 | 100.0 | 99.8 | 99.9 | 99.8 |

Motifs indicate the residues defining supertype specificites. The motifs incorporate residues determined on the basis of published data to be recognized by multiple alleles within the supertype. Residues within brackets are additional residues also predicted to be tolerated by multiple alleles within the supertype.

TABLE V

Frequently Occurring Motifs

| Name | avrg. % identity | Description | Potential Function |
|---|---|---|---|
| zf-C2H2 | 34% | Zinc finger, C2H2 type | Nucleic acid-binding protein functions as transcription factor, nuclear location probable |
| cytochrome_b_N | 68% | Cytochrome b(N-terminal)/b6/petB | membrane bound oxidase, generate superoxide |
| Ig | 19% | Immunoglobulin domain | domains are one hundred amino acids long and include a conserved intradomain disulfide bond. |
| WD40 | 18% | WD domain, G-beta repeat | tandem repeats of about 40 residues, each containing a Trp-Asp motif. Function in signal transduction and protein interaction |
| PDZ | 23% | PDZ domain | may function in targeting signaling molecules to sub-membranous sites |
| LRR | 28% | Leucine Rich Repeat | short sequence motifs involved in protein-protein interactions |
| Pkinase | 23% | Protein kinase domain | conserved catalytic core common to both serine/threonine and tyrosine |

TABLE V-continued

Frequently Occurring Motifs

| Name | avrg. % identity | Description | Potential Function |
|---|---|---|---|
| | | | protein kinases containing an ATP binding site and a catalytic site |
| PH | 16% | PH domain | pleckstrin homology involved in intracellular signaling or as constituents of the cytoskeleton |
| EGF | 34% | EGF-like domain | 30-40 amino-acid long found in the extracellular domain of membrane-bound proteins or in secreted proteins |
| Rvt | 49% | Reverse transcriptase (RNA-dependent DNA polymerase) | |
| Ank | 25% | Ank repeat | Cytoplasmic protein, associates integral membrane proteins to the cytoskeleton |
| Oxidored_q1 | 32% | NADH-Ubiquinone/plastoquinone (complex I), various chains | membrane associated. Involved in proton translocation across the membrane |
| Efhand | 24% | EF hand | calcium-binding domain, consists of a12 residue loop flanked on both sides by a 12 residue alpha-helical domain |
| Rvp | 79% | Retroviral aspartyl protease | Aspartyl or acid proteases, centered on a catalytic aspartyl residue |
| Collagen | 42% | Collagen triple helix repeat 20 copies) | extracellular structural proteins involved in formation of connective tissue. The sequence consists of the G-X-Y and the polypeptide chains forms a triple helix. |
| Fn3 | 20% | Fibronectin type III domain | Located in the extracellular ligand-binding region of receptors and is about 200 amino acid residues long with two pairs of cysteines involved in disulfide bonds |
| 7tm_1 | 19% | 7 transmembrane receptor (rhodopsin family) | seven hydrophobic transmembrane regions, with the N-terminus located extracellularly while the C-terminus is cytoplasmic. Signal through G proteins |

TABLE VI

Post-translational modifications of PSCA v.4

N-glycosylation site
91-94 NASL (SEQ ID NO:147)

cAMP- and cGMP-dependent protein kinase phosphorylation
10-13 RRTS (SEQ ID NO:148)

Protein kinase C phosphorylation site
 2-4 THR
12-14 TSR 35-37 SLR
51-53 SYR

N-myristoylation site
120-125 GSIDTD (SEQ ID NO:149)

Proline-rich region
18-134

TABLE VII

Search Peptides

```
Variant 1 aa 1-123: 9-mers, 10-mers, 15-mers (SEQ ID NO:150)
MKAVLLALLM AGLALQPGTA LLCYSCKAQV SNEDCLQVEN CTQLGEQCWT ARIRAVGLLT   60
VISKGCSLNC VDDSQDYYVG KKNITCCDTD LCNASGAHAL QPAAAILALL PALGLLLWGP  120
GQL                                                                123 v.4: aa 1-189: 9-mers, 10-mers, 15-mers (SEQ ID NO:151)
MTHRTTTWAR RTSRAVTPTC ATPAGPMPCS RLPPSLRCSL HSACCSGDPA SYRLWGAPLQ   60
PTLGVVPQAS VPLLTHPAQW EPVLVPEAHP NASLTMYVCA PVPHPDPPMA LSRTPTRQIG  120
SIDTDPPADG PSNPLCCCFH GPAFSTLNPV LRHLFPQEAF PAHPIYDLSQ VWSVVSPAPS  180
RGQALRRAR                                                          189

PSCA v.19
9-mers aa 25-41
GPMPCSRLLPSLRCSLH (SEQ ID NO:152)
```

TABLE VII-continued

Search Peptides 10-mers aa24-42
AGPMPCSRLLPSLRCSLHS (SEQ ID NO:153)
15-mers aa 19-47
TCATPAGPMPCSRLLPSLRCSLHSACCSG (SEQ ID NO:154)

PSCA v.20
9-mers aa 44-60
CCSGDPASSRLWGAPLQ (SEQ ID NO:155)
10-mers aa 43-61
ACCSGDPASSRLWGAPLQP (SEQ ID NO:156)
15-mers aa 38-66
CSLHSACCSGDPASSRLWGAPLQPTLGVV (SEQ ID NO:157)

PSCA v.21
9-mers aa 68-84
QASVPLLTDPAQWEPVL (SEQ ID NO:158)
10-mers aa 67-85
PQASVPLLTDPAQWEPVLV (SEQ ID NO:159)
15-mers aa 62-90
TLGVVPQASVPLLTDPAQWEPVLVPEAHP (SEQ ID NO:160)

PSCA v.21/22
9-mers aa 69-84
ASVPLLTDLAQWEPVL (SEQ ID NO:161)
10-mers aa 68-85
QASVPLLTDLAQWEPVLV (SEQ ID NO:162)
15-mers aa 63-90
LGVVPQASVPLLTDLAQWEPVLVPEAHP (SEQ ID NO:163)

PSCA v.22
9-mers aa 69-85
ASVPLLTHLAQWEPVLV (SEQ ID NO:164)
10-mers aa 68-86
QASVPLLTHLAQWEPVLVP (SEQ ID NO: 165)
15-mers aa 63-91
LGVVPQASVPLLTHLAQWEPVLVPEAHPN (SEQ ID NO:166)

PSCA v.24
9-mers aa 92-108
ASLTMYVCTPVPHPDP (SEQ ID NO:167)
10-mers aa 91-109
NASLTMYVCTPVPHPDPPM (SEQ ID NO:168)
15-mers aa 96-114
PEAHPNASLTMYVCTPVPHPDPPMALSRT (SEQ ID NO:169)

PSCA v.25
9-mers aa 112-128
SRTPTRQISSIDTDPPA (SEQ ID NO:170)
10-mers aa 111-129
LSRTPTRQISSIDTDPPAD (SEQ ID NO:171)
15-mers aa 106-134
DPPMALSRTPTRQISSIDTDPPADGPSNP (SEQ ID NO:172)

PSCA v.25/26
9-mers aa 27-128
TPTRQISSSDTDPPA (SEQ ID NO:173)
10-mers aa 26-129
RTPTRQISSSDTDPPAD (SEQ ID NO:174)
15-mers aa 108-134
PMALSRTPTRQISSSDTDPPADGPSNP (SEQ ID NO:175)

PSCA v.26
9-mers aa 114-130
TPTRQIGSSDTDPPADG (SEQ ID NO:176)
10-mers aa 113-131
RTPTRQIGSSDTDPPADGP (SEQ ID NO:177)
15-mers aa 108-136
PMALSRTPTRQIGSSDTDPPADGPSNPLC (SEQ ID NO:178)

PSCA v.27
9-mers aa 181-189
RGQALRRAQ (SEQ ID NO:179)
10-mers aa 180-189
SRGQALRRAQ (SEQ ID NO:180)
15-mers aa 175-189
VSPAPSRGQALRRAQ (SEQ ID NO:181)

Tables VIII-XXI

TABLE VIII

V1-HLA-A1-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 70 | CVDDSQDYY (SEQ ID NO: 182) | 25.000 |
| 88 | DTDLCNASG (SEQ ID NO: 183) | 2.500 |
| 44 | LGEQCWTAR (SEQ ID NO: 184) | 2.250 |
| 74 | SQDYYVGKK (SEQ ID NO: 185) | 1.500 |
| 37 | QVENCTQLG (SEQ ID NO: 186) | 0.900 |
| 16 | QPGTALLCY (SEQ ID NO: 187) | 0.625 |
| 73 | DSQDYYVGK (SEQ ID NO: 188) | 0.600 |
| 69 | NCVDDSQDY (SEQ ID NO: 189) | 0.500 |
| 86 | CCDTDLCNA (SEQ ID NO: 190) | 0.500 |
| 56 | VGLLTVISK (SEQ ID NO: 191) | 0.250 |
| 99 | ALQPAAAIL (SEQ ID NO: 192) | 0.200 |
| 14 | ALQPGTALL (SEQ ID NO: 193) | 0.200 |
| 19 | TALLCYSCK (SEQ ID NO: 194) | 0.200 |
| 108 | ALLPALGLL (SEQ ID NO: 195) | 0.100 |
| 30 | VSNEDCLQV (SEQ ID NO: 196) | 0.075 |
| 85 | TCCDTDLCN (SEQ ID NO: 197) | 0.050 |
| 107 | LALLPALGL (SEQ ID NO: 198) | 0.050 |
| 2 | KAVLLALLM (SEQ ID NO: 199) | 0.050 |
| 3 | AVLLALLMA (SEQ ID NO: 200) | 0.050 |
| 104 | MILALLPAW (SEQ ID NO: 201) | 0.050 |
| 71 | VDDSQDYYV (SEQ ID NO: 202) | 0.050 |
| 18 | GTALLCYSC (SEQ ID NO: 203) | 0.050 |
| 4 | VLLALLMAG (SEQ ID NO: 204) | 0.050 |
| 32 | NEDCLQVEN (SEQ ID NO: 205) | 0.050 |
| 7 | ALLMAGLAL (SEQ ID NO: 206) | 0.050 |
| 109 | LLPALGLLL (SEQ ID NO: 207) | 0.050 |
| 84 | ITCCDTDLC (SEQ ID NO: 208) | 0.025 |
| 41 | CTQLGEQCW (SEQ ID NO: 209) | 0.025 |
| 59 | LTVISKGCS (SEQ ID NO: 210) | 0.025 |
| 31 | SNEDCLQVE (SEQ ID NO: 211) | 0.022 |
| 22 | LCYSCKAQV (SEQ ID NO: 212) | 0.020 |
| 106 | ILALLPALG (SEQ ID NO: 213) | 0.020 |
| 8 | LLMAGLALQ (SEQ ID NO: 214) | 0.020 |

TABLE VIII-continued

V1-HLA-A1-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 91 | LCNASGAHA (SEQ ID NO: 215) | 0.020 |
| 5 | LLALLMAGL (SEQ ID NO: 216) | 0.020 |
| 98 | HALQPAAAI (SEQ ID NO: 217) | 0.020 |
| 105 | AILALLPAL (SEQ ID NO: 218) | 0.020 |
| 96 | GAHALQPAA (SEQ ID NO: 219) | 0.020 |
| 93 | NASGAHALQ (SEQ ID NO: 220) | 0.020 |
| 55 | AVGLLTVIS (SEQ ID NO: 221) | 0.020 |
| 114 | GLLLWGPGQ (SEQ ID NO: 222) | 0.020 |
| 66 | CSLNCVDDS (SEQ ID NO: 223) | 0.015 |
| 46 | EQCWTARIR (SEQ ID NO: 224) | 0.015 |
| 101 | QPAAAILAL (SEQ ID NO: 225) | 0.013 |
| 110 | LPALGLLLW (SEQ ID NO: 226) | 0.013 |
| 58 | LLTVISKGC (SEQ ID NO: 227) | 0.010 |
| 115 | LLLWGPGQL (SEQ ID NO: 228) | 0.010 |
| 13 | LALQPGTAL (SEQ ID NO: 229) | 0.010 |
| 27 | KAQVSNEDC (SEQ ID NO: 230) | 0.010 |
| 20 | ALLCYSCKA (SEQ ID NO: 231) | 0.010 |
| 35 | CLQVENCTQ (SEQ ID NO: 232) | 0.010 |
| 43 | QLGEQCWTA (SEQ ID NO: 233) | 0.010 |
| 29 | QVSNEDCLQ (SEQ ID NO: 234) | 0.010 |
| 34 | DCLQVENCT (SEQ ID NO: 235) | 0.010 |
| 54 | RAVGLLTVI (SEQ ID NO: 236) | 0.010 |
| 40 | NCTQLGEQC (SEQ ID NO: 237) | 0.010 |
| 12 | GLALQPGTA (SEQ ID NO: 238) | 0.010 |
| 83 | NITCCDTDL (SEQ ID NO: 239) | 0.010 |
| 6 | LALLMAGLA (SEQ ID NO: 240) | 0.010 |
| 21 | LLCYSCKAQ (SEQ ID NO: 241) | 0.010 |
| 90 | DLCNASGAH (SEQ ID NO: 242) | 0.010 |
| 60 | TVISKGCSL (SEQ ID NO: 243) | 0.010 |
| 67 | SLNCVDDSQ (SEQ ID NO: 244) | 0.010 |
| 10 | MAGLALQPG (SEQ ID NO: 245) | 0.010 |
| 57 | GLLTVISKG (SEQ ID NO: 246) | 0.010 |
| 62 | ISKGCSLNC (SEQ ID NO: 247) | 0.008 |
| 94 | ASGAHALQP (SEQ ID NO: 248) | 0.007 |

TABLE VIII-continued

V1-HLA-A1-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 100 | LQPAAAILA (SEQ ID NO: 249) | 0.007 |
| 15 | LQPGTALLC (SEQ ID NO: 250) | 0.007 |
| 47 | QCWTARIRA (SEQ ID NO: 251) | 0.005 |
| 52 | RIRAVGLLT (SEQ ID NO: 252) | 0.005 |
| 78 | YVGKKNITC (SEQ ID NO: 253) | 0.005 |
| 111 | PALGLLLWG (SEQ ID NO: 254) | 0.005 |
| 11 | AGLALQPGT (SEQ ID NO: 255) | 0.005 |
| 49 | WTARIRAVG (SEQ ID NO: 256) | 0.005 |
| 103 | IMAILALLP (SEQ ID NO: 257) | 0.005 |
| 24 | YSCKAQVSN (SEQ ID NO: 258) | 0.003 |
| 39 | ENCTQLGEQ (SEQ ID NO: 259) | 0.003 |
| 113 | LGLLLWGPG (SEQ ID NO: 260) | 0.003 |
| 95 | SGAHALQPA (SEQ ID NO: 261) | 0.003 |
| 9 | LMAGLALQP (SEQ ID NO: 262) | 0.003 |
| 92 | CNASGAHAL (SEQ ID NO: 263) | 0.003 |
| 53 | IRAVGLLTV (SEQ ID NO: 264) | 0.003 |
| 50 | TARIRAVGL (SEQ ID NO: 265) | 0.002 |

TABLE VIII-continued

V1-HLA-A1-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 102 | PAAAILALL (SEQ ID NO: 266) | 0.002 |
| 65 | GCSLNCVDD (SEQ ID NO: 267) | 0.002 |
| 42 | TQLGEQCWT (SEQ ID NO: 268) | 0.002 |
| 28 | AQVSNEDCL (SEQ ID NO: 269) | 0.002 |
| 36 | LQVENCTQL (SEQ ID NO: 270) | 0.002 |
| 112 | ALGLLLWGP (SEQ ID NO: 271) | 0.001 |
| 45 | GEQCWTARI (SEQ ID NO: 272) | 0.001 |
| 72 | DDSQDYYVG (SEQ ID NO: 273) | 0.001 |
| 97 | AHALQPAAA (SEQ ID NO: 274) | 0.001 |
| 1 | MKAVLLALL (SEQ ID NO: 275) | 0.001 |
| 61 | VISKGCSLN (SEQ ID NO: 276) | 0.001 |
| 76 | DYYVGKKNI (SEQ ID NO: 277) | 0.001 |
| 48 | CWIARIRAV (SEQ ID NO: 278) | 0.001 |
| 33 | EDCLQVENC (SEQ ID NO: 279) | 0.001 |
| 81 | KKNITCCDT (SEQ ID NO: 280) | 0.001 |
| 89 | TDLCNASGA (SEQ ID NO: 281) | 0.001 |

TABLE VIII

V4-HLA-A1-9MERS-PSCA
Each peptide is a portion of SEQ ID NO:8; each start psoition is specified, the length of peptide is 9 amino acids, and the end position for each peptide is the start position plus eight.

| START | SUBSEQUENCE | SCORE |
|---|---|---|
| 158 | EAFPAHPIY (SEQ ID NO: 282) | 10.000 |
| 46 | SGDPASYRL (SEQ ID NO: 283) | 2.500 |
| 104 | HPDPPMALS (SEQ ID NO: 284) | 2.500 |
| 123 | DTDPPADGP (SEQ ID NO: 285) | 1.250 |
| 44 | CCSGDPASY (SEQ ID NO: 286) | 1.000 |
| 144 | FSTLNPVLR (SEQ ID NO: 287) | 0.300 |
| 85 | VPEAHPNAS (SEQ ID NO: 288) | 0.225 |
| 109 | MALSRTPTR (SEQ ID NO: 289) | 0.200 |
| 136 | CCCFHGPAF (SEQ ID NO: 290) | 0.200 |
| 173 | SVVSPAPSR (SEQ ID NO: 291) | 0.200 |
| 131 | PSNPLCCCF (SEQ ID NO: 292) | 0.150 |
| 45 | CSGDPASYR (SEQ ID NO: 293) | 0.150 |
| 89 | HPNASLTMY (SEQ ID NO: 294) | 0.125 |
| 21 | ATPAGPMPC (SEQ ID NO: 295) | 0.125 |
| 113 | RTPTRQIGS (SEQ ID NO: 296) | 0.125 |
| 145 | STLNPVLRH (SEQ ID NO: 297) | 0.125 |
| 83 | VLVPEAHPN (SEQ ID NO: 298) | 0.100 |

TABLE VIII-continued

V4-HLA-A1-9MERS-PSCA
Each peptide is a portion of SEQ ID NO:8; each start psoition is specified, the length of peptide is 9 amino acids, and the end position for each peptide is the start position plus eight.

| START | SUBSEQUENCE | SCORE |
|---|---|---|
| 31 | RLPPSLRCS (SEQ ID NO: 299) | 0.100 |
| 87 | EAHPNASLT (SEQ ID NO: 300) | 0.100 |
| 23 | PAGPMPCSR (SEQ ID NO: 301) | 0.100 |
| 146 | TLNPVLRHL (SEQ ID NO: 302) | 0.100 |
| 174 | VVSPAPSRG (SEQ ID NO: 303) | 0.100 |
| 121 | SIDTDPPAD (SEQ ID NO: 304) | 0.100 |
| 79 | QWEPVLVPE (SEQ ID NO: 305) | 0.090 |
| 165 | IYDLSQVWS (SEQ ID NO: 306) | 0.050 |
| 94 | LTMYVCAPV (SEQ ID NO: 307) | 0.050 |
| 127 | PADGPSNPL (SEQ ID NO: 308) | 0.050 |
| 102 | VPHPDPPMA (SEQ ID NO: 309) | 0.050 |
| 55 | WGAPLQPTL (SEQ ID NO: 310) | 0.050 |
| 68 | QASVPLLTH (SEQ ID NO: 311) | 0.050 |
| 120 | GSIDTDPPA (SEQ ID NO: 312) | 0.030 |
| 92 | ASLTMYVCA (SEQ ID NO: 313) | 0.030 |
| 168 | LSQVWSVVS (SEQ ID NO: 314) | 0.030 |
| 172 | WSVVSPAPS (SEQ ID NO: 315) | 0.030 |

TABLE VIII-continued

V4-HLA-A1-9MERS-PSCA
Each peptide is a portion of SEQ ID NO:8; each start psoition is specified, the length of peptide is 9 amino acids, and the end position for each peptide is the start position plus eight.

| START | SUBSEQUENCE | SCORE |
|---|---|---|
| 105 | PDPPMALSR (SEQ ID NO: 316) | 0.025 |
| 30 | SRLPPSLRC (SEQ ID NO: 317) | 0.025 |
| 147 | LNPVLRHLF (SEQ ID NO: 318) | 0.025 |
| 181 | RGQALRRAR (SEQ ID NO: 319) | 0.025 |
| 176 | SPAPSRGQA (SEQ ID NO: 320) | 0.025 |
| 16 | VTPTCATPA (SEQ ID NO: 321) | 0.025 |
| 74 | LTHPAQWEP (SEQ ID NO: 322) | 0.025 |
| 4 | RTTTWARRT (SEQ ID NO: 323) | 0.025 |
| 6 | TTWARRTSR (SEQ ID NO: 324) | 0.025 |
| 5 | TTTSARRTS (SEQ ID NO: 325) | 0.025 |
| 91 | NASLTMYVC (SEQ ID NO: 326) | 0.020 |
| 43 | ACCSGDPAS (SEQ ID NO: 327) | 0.020 |
| 37 | RCSLHSACC (SEQ ID NO: 328) | 0.020 |
| 15 | AVTPTCATP (SEQ ID NO: 329) | 0.020 |
| 20 | CATPAGPMP (SEQ ID NO: 330) | 0.020 |
| 84 | LVPEAHPNA (SEQ ID NO: 331) | 0.020 |
| 65 | VVPQASVPL (SEQ ID NO: 332) | 0.020 |
| 137 | CCFHGPAFS (SEQ ID NO: 333) | 0.020 |
| 153 | HLFPQEAFP (SEQ ID NO: 334) | 0.020 |
| 29 | CSRLPPSLR (SEQ ID NO: 335) | 0.015 |
| 69 | ASVPLLTHP (SEQ ID NO: 336) | 0.015 |
| 175 | VSPAPSRGQ (SEQ ID NO: 337) | 0.015 |
| 38 | CSLHSACCS (SEQ ID NO: 338) | 0.015 |
| 129 | DGPSNPLCC (SEQ ID NO: 339) | 0.013 |
| 133 | NPLCCCFHG (SEQ ID NO: 340) | 0.013 |
| 48 | DPASYRLWG (SEQ ID NO: 341) | 0.013 |
| 57 | APLQPTLGV (SEQ ID NO: 342) | 0.013 |
| 161 | PAHPIYDLS (SEQ ID NO: 343) | 0.010 |
| 3 | HRTTTWARR (SEQ ID NO: 344) | 0.010 |
| 42 | SACCSGDPA (SEQ ID NO: 345) | 0.010 |
| 19 | TCATPAGPM (SEQ ID NO: 346) | 0.010 |
| 58 | PLQPTLGVV (SEQ ID NO: 347) | 0.010 |
| 14 | RAVTPTCAT (SEQ ID NO: 348) | 0.010 |
| 64 | GVVPQASVP (SEQ ID NO: 349) | 0.010 |

TABLE VIII-continued

V4-HLA-A1-9MERS-PSCA
Each peptide is a portion of SEQ ID
NO:8; each start psoition is
specified, the length of peptide is 9
amino acids, and the end position
for each peptide is the start position
plus eight.

| START | SUBSEQUENCE | SCORE |
|---|---|---|
| 135 | LCCCFHGPA (SEQ ID NO: 350) | 0.010 |
| 128 | ADGPSNPLC (SEQ ID NO: 351) | 0.010 |
| 98 | VCAPVPHPD (SEQ ID NO: 352) | 0.010 |
| 56 | GAPLQPTLG (SEQ ID NO: 353) | 0.010 |
| 62 | TLGVVPQAS (SEQ ID NO: 354) | 0.010 |
| 167 | DLSQVWSVV (SEQ ID NO: 355) | 0.010 |
| 39 | SLHSACCSG (SEQ ID NO: 356) | 0.010 |
| 70 | SVPLLTHPA (SEQ ID NO: 357) | 0.010 |
| 179 | PSRGQALRR (SEQ ID NO: 358) | 0.008 |
| 66 | VPQASVPLL (SEQ ID NO: 359) | 0.005 |
| 124 | TDPPADGPS (SEQ ID NO: 360) | 0.005 |
| 139 | FHGPAFSTL (SEQ ID NO: 361) | 0.005 |
| 63 | LGVVPQASV (SEQ ID NO: 362) | 0.005 |
| 125 | DPPADGPSN (SEQ ID NO: 363) | 0.005 |
| 22 | TPAGPMPCS (SEQ ID NO: 364) | 0.005 |
| 76 | HPAQWEPVL (SEQ ID NO: 365) | 0.005 |
| 17 | TPTCATPAG (SEQ ID NO: 366) | 0.005 |

TABLE VIII-continued

V4-HLA-A1-9MERS-PSCA
Each peptide is a portion of SEQ ID
NO:8; each start psoition is
specified, the length of peptide is 9
amino acids, and the end position
for each peptide is the start position
plus eight.

| START | SUBSEQUENCE | SCORE |
|---|---|---|
| 112 | SRTPTRQIG (SEQ ID NO: 367) | 0.005 |
| 71 | VPLLTHPAQ (SEQ ID NO: 368) | 0.005 |
| 160 | FPAHPIYDL (SEQ ID NO: 369) | 0.005 |
| 152 | RHLFPQEAF (SEQ ID NO: 370) | 0.005 |
| 60 | QPTLGVVPQ (SEQ ID NO: 371) | 0.005 |
| 178 | APSRGQALR (SEQ ID NO: 372) | 0.005 |
| 27 | MPCSRLPPS (SEQ ID NO: 373) | 0.005 |
| 155 | FPQEAFPAH (SEQ ID NO: 374) | 0.005 |
| 61 | PTLGVVPQA (SEQ ID NO: 375) | 0.005 |
| 12 | TSRAVTPTC (SEQ ID NO: 376) | 0.003 |
| 156 | PQEAFPAHP (SEQ ID NO: 377) | 0.003 |
| 24 | AGPMPCSRL (SEQ ID NO: 378) | 0.003 |
| 138 | CFHGPAFST (SEQ ID NO: 379) | 0.003 |
| 140 | HGPAFSTLN (SEQ ID NO: 380) | 0.003 |
| 88 | AHPNASLTM (SEQ ID NO: 381) | 0.003 |

TABLE VII

V19-HLA-A1-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 7 | RLLPSLRCS (SEQ ID NO: 382) | 0.100 |
| 1 | GPMPCSRLL (SEQ ID NO: 383) | 0.025 |
| 5 | CSRLLPSLR (SEQ ID NO: 384) | 0.015 |
| 3 | MPCSRLLPS (SEQ ID NO: 385) | 0.013 |
| 8 | LLPSLRCSL (SEQ ID NO: 386) | 0.010 |
| 6 | SRLLPSLRC (SEQ ID NO: 387) | 0.003 |
| 9 | LPSLRCSLH (SEQ ID NO: 388) | 0.003 |
| 2 | PMPCSRLLP (SEQ ID NO: 389) | 0.000 |
| 4 | PCSRLLPSL (SEQ ID NO: 390) | 0.000 |

TABLE VIII

V20-HLA-A1-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 3 | SGDPASSRL (SEQ ID NO: 391) | 1.250 |
| 2 | CSGDPASSR (SEQ ID NO: 392) | 0.150 |
| 1 | CCSGDPASS (SEQ ID NO: 393) | 0.020 |
| 5 | DPASSRLWG (SEQ ID NO: 394) | 0.013 |
| 8 | SSRLWGAPL (SEQ ID NO: 395) | 0.003 |
| 6 | PASSRLWGA (SEQ ID NO: 396) | 0.001 |
| 9 | SRLWGAPLQ (SEQ ID NO: 397) | 0.001 |
| 4 | GDPASSRLW (SEQ ID NO: 398) | 0.001 |
| 7 | ASSRLWGAP (SEQ ID NO: 399) | 0.000 |

TABLE VIII

V21-HLA-A1-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 7 | LTDPAQWEP (SEQ ID NO: 400) | 1.250 |
| 2 | ASVPLLTDP (SEQ ID NO: 401) | 0.015 |
| 3 | SVPLLTDPA (SEQ ID NO: 402) | 0.010 |
| 9 | DPAQWEPVL (SEQ ID NO: 403) | 0.005 |
| 1 | QASVPLLTD (SEQ ID NO: 404) | 0.005 |
| 4 | VPLLTDPAQ (SEQ ID NO: 405) | 0.005 |
| 5 | PLLTDPAQW (SEQ ID NO: 406) | 0.002 |
| 6 | LLTDPAQWE (SEQ ID NO: 407) | 0.001 |
| 8 | TDPAQWEPV (SEQ ID NO: 408) | 0.001 |

TABLE VIII

V21&V22-HLA-A1-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 1 | ASVPLLTDL (SEQ ID NO: 409) | 0.150 |
| 6 | LTDLAQWEP (SEQ ID NO: 410) | 0.125 |
| 8 | DLAQWEPVL (SEQ ID NO: 411) | 0.020 |
| 3 | VPLLTDLAQ (SEQ ID NO: 412) | 0.013 |
| 2 | SVPLLTDLA (SEQ ID NO: 413) | 0.010 |
| 4 | PLLTDLAQW (SEQ ID NO: 414) | 0.002 |
| 5 | LLTDLAQWE (SEQ ID NO: 415) | 0.001 |
| 7 | TDLAQWEPV (SEQ ID NO: 416) | 0.001 |

TABLE VIII

V22-HLA-A1-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 1 | ASYPLLTHL (SEQ ID NO: 417) | 0.150 |
| 8 | HLAQWEPVL (SEQ ID NO: 418) | 0.020 |
| 9 | LAQWEPVLV (SEQ ID NO: 419) | 0.020 |
| 3 | VPLLTHLAQ (SEQ ID NO: 420) | 0.013 |
| 2 | SVPLLTHLA (SEQ ID NO: 421) | 0.010 |
| 6 | LTHLAQWEP (SEQ ID NO: 422) | 0.003 |
| 4 | PLLTHLAQW (SEQ ID NO: 423) | 0.002 |
| 5 | LLTHLAQWE (SEQ ID NO: 424) | 0.001 |
| 7 | THLAQWEPV (SEQ ID NO: 425) | 0.001 |

TABLE VIII

V24-HLA-A1-9MERS-PSCA
Each is a portion of SEQ ID NO: 8; each start position is specified, the length of peptide is 9 amino acids, and the end position for each peptide is the start position plus eight.

| START | SUBSEQUENCE | SCORE |
|---|---|---|
| 1 | ASLTMYVCT (SEQ ID NO: 426) | 0.030 |
| 3 | LTMYVCTPV (SEQ ID NO: 427) | 0.025 |
| 7 | VCTPVPHPD (SEQ ID NO: 428) | 0.010 |
| 8 | CTPVPHPDP (SEQ ID NO: 429) | 0.005 |
| 6 | YVCTPVPHP (SEQ ID NO: 430) | 0.002 |
| 4 | TMYVCTPVP (SEQ ID NO: 431) | 0.001 |
| 2 | SLTMYVCTP (SEQ ID NO: 432) | 0.001 |
| 5 | MYVCTPVPH (SEQ ID NO: 433) | 0.001 |

TABLE VIII

V25-HLA-A1-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 2 | RTPTRQISS (SEQ ID NO: 434) | 0.125 |
| 9 | SSIDTDPPA (SEQ ID NO: 435) | 0.030 |
| 1 | SRTPTRQIS (SEQ ID NO: 436) | 0.005 |
| 5 | TRQISSIDT (SEQ ID NO: 437) | 0.003 |
| 8 | ISSIDTDPP (SEQ ID NO: 438) | 0.002 |
| 7 | QISSIDTDP (SEQ ID NO: 439) | 0.001 |
| 3 | TPTRQISSI (SEQ ID NO: 440) | 0.000 |
| 6 | RQISSIDTD (SEQ ID NO: 441) | 0.000 |
| 4 | PTRQISSID (SEQ ID NO: 442) | 0.000 |

TABLE VIII

V25&26-HLA-A1-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 7 | SSSDTDPPA (SEQ ID NO: 443) | 0.030 |
| 6 | ISSSDTDPP (SEQ ID NO: 444) | 0.002 |
| 5 | QISSSDTDP (SEQ ID NO: 445) | 0.001 |
| 3 | TRQISSSDT (SEQ ID NO: 446) | 0.001 |
| 1 | TPTRQISSS (SEQ ID NO: 447) | 0.000 |
| 4 | RQISSSDTD (SEQ ID NO: 448) | 0.000 |
| 2 | PTRQISSSD (SEQ ID NO: 449) | 0.000 |

TABLE VIII

V26-HLA-A1-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 8 | SSDTDPPAD (SEQ ID NO: 450) | 0.150 |
| 7 | GSSDTDPPA (SEQ ID NO: 451) | 0.030 |
| 9 | SDTDPPADG (SEQ ID NO: 452) | 0.001 |
| 5 | QIGSSDTDP (SEQ ID NO: 453) | 0.001 |
| 3 | TRQIGSSDT (SEQ ID NO: 454) | 0.001 |
| 6 | IGSSDTDPP (SEQ ID NO: 455) | 0.000 |
| 1 | TPTRQIGSS (SEQ ID NO: 456) | 0.000 |
| 4 | RQIGSSDTD (SEQ ID NO: 457) | 0.000 |
| 2 | PTRQIGSSD (SEQ ID NO: 458) | 0.000 |

TABLE VIII

V27-HLA-A1-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 2 | RGQALRRAQ (SEQ ID NO: 459) | 0.003 |
| 1 | SRGQALRRA (SEQ ID NO: 460) | 0.001 |

TABLE IX

V1-HLA-A1-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 88 | DTDLCNASGA (SEQ ID NO: 461) | 1.250 |
| 70 | CVDDSQDYYV (SEQ ID NO: 462) | 1.000 |
| 55 | AVGLLTVISK (SEQ ID NO: 463) | 1.000 |
| 108 | ALLPALGLLL (SEQ ID NO: 464) | 0.500 |
| 99 | ALQPAAAILA (SEQ ID NO: 465) | 0.500 |
| 14 | ALQPGTALLC (SEQ ID NO: 466) | 0.500 |
| 86 | CCDTDLCNAS (SEQ ID NO: 467) | 0.500 |
| 18 | GTALLCYSCK (SEQ ID NO: 468) | 0.500 |
| 69 | NCVDDSQDYY (SEQ ID NO: 469) | 0.500 |
| 31 | SNEDCLQVEN (SEQ ID NO: 470) | 0.450 |
| 44 | LGEQCWTARI (SEQ ID NO: 471) | 0.450 |

TABLE IX-continued

V1-HLA-A1-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 37 | QVENCTQLGE (SEQ ID NO: 472) | 0.450 |
| 15 | LQPGTALLCY (SEQ ID NO: 473) | 0.375 |
| 73 | DSQDYYVGKK (SEQ ID NO: 474) | 0.300 |
| 84 | ITCCDTDLCN (SEQ ID NO: 475) | 0.125 |
| 68 | LNCVDDSQDY (SEQ ID NO: 476) | 0.125 |
| 43 | QLGEQCWTAR (SEQ ID NO: 477) | 0.100 |
| 74 | SQDYYVGKKN (SEQ ID NO: 478) | 0.075 |
| 29 | QVSNEDCLQV (SEQ ID NO: 479) | 0.050 |
| 3 | AVLLALLMAG (SEQ ID NO: 480) | 0.050 |
| 103 | AAAILALLPA (SEQ ID NO: 481) | 0.050 |
| 109 | LLPALGLLLW (SEQ ID NO: 482) | 0.050 |
| 6 | LALLMAGLAL (SEQ ID NO: 483) | 0.050 |
| 2 | KAVLLALLMA (SEQ ID NO: 484) | 0.050 |
| 106 | ILALLPALGL (SEQ ID NO: 485) | 0.050 |
| 71 | VDDSQDYYVG (SEQ ID NO: 486) | 0.050 |
| 41 | CTQLGEQCWT (SEQ ID NO: 487) | 0.025 |
| 32 | NEDCLQVENC (SEQ ID NO: 488) | 0.025 |

TABLE IX-continued

V1-HLA-A1-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 59 | LTVISKGCSL (SEQ ID NO: 489) | 0.025 |
| 4 | VLLALLMAGL (SEQ ID NO: 490) | 0.020 |
| 72 | DDSQDYYVGK (SEQ ID NO: 491) | 0.020 |
| 10 | MAGLALQPGT (SEQ ID NO: 492) | 0.020 |
| 104 | AAILALLPAL (SEQ ID NO: 493) | 0.020 |
| 21 | LLCYSCKAQV (SEQ ID NO: 494) | 0.020 |
| 96 | GAHALQPAAA (SEQ ID NO: 495) | 0.020 |
| 105 | AILALLPALG (SEQ ID NO: 496) | 0.020 |
| 90 | DLCNASGAHA (SEQ ID NO: 497) | 0.020 |
| 13 | LALQPGTALL (SEQ ID NO: 498) | 0.020 |
| 98 | HALQPAAAIL (SEQ ID NO: 499) | 0.020 |
| 7 | ALLMAGLALQ (SEQ ID NO: 500) | 0.020 |
| 54 | RAVGLLTVIS (SEQ ID NO: 501) | 0.020 |
| 94 | ASGAHALQPA (SEQ ID NO: 502) | 0.015 |
| 66 | CSLNCVDDSQ (SEQ ID NO: 503) | 0.015 |
| 10 | LPALGLLLWG (SEQ ID NO: 504) | 0.013 |
| 12 | GLALQPGTAL (SEQ ID NO: 505) | 0.010 |

TABLE IX-continued

V1-HLA-A1-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 85 | TCCDTDLCNA (SEQ ID NO: 506) | 0.010 |
| 20 | ALLCYSCKAQ (SEQ ID NO: 507) | 0.010 |
| 22 | LCYSCKAQVS (SEQ ID NO: 508) | 0.010 |
| 5 | LLALLMAGLA (SEQ ID NO: 509) | 0.010 |
| 35 | CLQVENCTQL (SEQ ID NO: 510) | 0.010 |
| 58 | LLTVISKGCS (SEQ ID NO: 511) | 0.010 |
| 19 | TALLCYSCKA (SEQ ID NO: 512) | 0.010 |
| 60 | TYISKGCSLN (SEQ ID NO: 513) | 0.010 |
| 34 | DCLQVENCTQ (SEQ ID NO: 514) | 0.010 |
| 114 | GLLLWGPGQL (SEQ ID NO: 515) | 0.010 |
| 27 | KAQVSNEDCL (SEQ ID NO: 516) | 0.010 |
| 112 | ALGLLLWGPG (SEQ ID NO: 517) | 0.010 |
| 107 | LALLPALGLL (SEQ ID NO: 518) | 0.010 |
| 65 | GCSLNCVDDS (SEQ ID NO: 519) | 0.010 |
| 91 | LCNASGAHAL (SEQ ID NO: 520) | 0.010 |
| 40 | NCTQLGEQCW (SEQ ID NO: 521) | 0.010 |
| 57 | GLLTVISKGC (SEQ ID NO: 522) | 0.010 |

TABLE IX-continued

V1-HLA-A1-10MERS-PSCA
Each peptide is a portion of SEQ ID
NO: 2; each start position is
specified, the length of peptide is 10
amino acids, and the end position
for each peptide is the start
position plus nine.

| START | SUBSEQUENCE | SCORE |
|---|---|---|
| 83 | NITCCDTDLC (SEQ ID NO: 523) | 0.010 |
| 46 | EQCWTARIRA (SEQ ID NO: 524) | 0.007 |
| 100 | LQPAAAILAL (SEQ ID NO: 525) | 0.007 |
| 61 | VISKGCSLNC (SEQ ID NO: 526) | 0.005 |
| 92 | CNASGAHALQ (SEQ ID NO: 527) | 0.005 |
| 95 | SGAHALQPAA (SEQ ID NO: 528) | 0.005 |
| 45 | GEQCVVTARV (SEQ ID NO: 529) | 0.005 |
| 52 | RIRAVGLLTV (SEQ ID NO: 530) | 0.005 |
| 113 | LGLLLWGPGQ (SEQ ID NO: 531) | 0.005 |
| 93 | NASGAHALQP (SEQ ID NO: 532) | 0.005 |
| 49 | WTARIRAVGL (SEQ ID NO: 533) | 0.005 |
| 8 | LLMAGLALQP (SEQ ID NO: 534) | 0.005 |
| 9 | LMAGLALQPG (SEQ ID NO: 535) | 0.005 |
| 101 | QPAAAILALL (SEQ ID NO: 536) | 0.005 |
| 77 | YYVGKKNITC (SEQ ID NO: 537) | 0.003 |
| 82 | KNITCCDTDL (SEQ ID NO: 538) | 0.003 |
| 11 | AGLALQPGTA (SEQ ID NO: 539) | 0.003 |

TABLE IX-continued

V1-HLA-A1-10MERS-PSCA
Each peptide is a portion of SEQ ID
NO: 2; each start position is
specified, the length of peptide is 10
amino acids, and the end position
for each peptide is the start
position plus nine.

| START | SUBSEQUENCE | SCORE |
|---|---|---|
| 16 | QPGTALLCYS (SEQ ID NO: 540) | 0.003 |
| 1 | MKAVLLALLM (SEQ ID NO: 541) | 0.003 |
| 56 | VGLLTVISKG (SEQ ID NO: 542) | 0.003 |
| 39 | ENCTQLGEQC (SEQ ID NO: 543) | 0.003 |
| 62 | ISKGCSLNCV (SEQ ID NO: 544) | 0.002 |
| 30 | VSNEDCLQVE (SEQ ID NO: 545) | 0.002 |
| 28 | AQVSNEDCLQ (SEQ ID NO: 546) | 0.002 |
| 36 | LQVENCTQLG (SEQ ID NO: 547) | 0.002 |
| 42 | TQLGEQCWTA (SEQ ID NO: 548) | 0.002 |
| 48 | CWTARIRAVG (SEQ ID NO: 549) | 0.001 |
| 67 | SLNCVDDSQD (SEQ ID NO: 550) | 0.001 |
| 78 | YVGKKNITCC (SEQ ID NO: 551) | 0.001 |
| 87 | CDTDLCNASG (SEQ ID NO: 552) | 0.001 |
| 97 | AHALQPAAAI (SEQ ID NO: 553) | 0.001 |
| 47 | QCWTARIRAV (SEQ ID NO: 554) | 0.001 |
| 23 | CYSCKAQVSN (SEQ ID NO: 555) | 0.001 |
| 50 | TARIRAVGLE (SEQ ID NO: 556) | 0.001 |

TABLE IX-continued

V1-HLA-A1-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 102 | PAAAILALLP (SEQ ID NO: 557) | 0.001 |
| 26 | CKAQVSNEDC (SEQ ID NO: 558) | 0.001 |
| 89 | TDLCNASGAH (SEQ ID NO: 559) | 0.001 |
| 38 | VENCTQLGEQ (SEQ ID NO: 560) | 0.001 |

TABLE IX

V4-HLA-A1-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 104 | HPDPPMALSR (SEQ ID NO: 561) | 62.500 |
| 123 | DTDPPADGPS (SEQ ID NO: 562) | 12.500 |
| 46 | SGDPASYRLW (SEQ ID NO: 563) | 1.250 |
| 43 | ACCSGDPASY (SEQ ID NO: 564) | 1.000 |
| 121 | SIDTDPPADG (SEQ ID NO: 565) | 1.000 |
| 146 | TLNPVLRHLF (SEQ ID NO: 566) | 1.000 |
| 79 | QWEPVLVPEA (SEQ ID NO: 567) | 0.900 |
| 20 | CATPAGPMPC (SEQ ID NO: 568) | 0.500 |
| 87 | EAHPNASLTM (SEQ ID NO: 569) | 0.500 |

TABLE IX-continued

V4-HLA-A1-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 153 | HLFPQEAFPA (SEQ ID NO: 570) | 0.500 |
| 85 | VPEAHPNASL (SEQ ID NO: 571) | 0.450 |
| 172 | WSVVSPAPSR (SEQ ID NO: 572) | 0.300 |
| 5 | TTTWARRTSR (SEQ ID NO: 573) | 0.250 |
| 74 | LTHPAQWEPV (SEQ ID NO: 574) | 0.250 |
| 135 | LCCCFHGPAF (SEQ ID NO: 575) | 0.200 |
| 64 | GVVPQASVPL (SEQ ID NO: 576) | 0.200 |
| 83 | VLVPEAHPNA (SEQ ID NO: 577) | 0.200 |
| 69 | ASVPLLTHPA (SEQ ID NO: 578) | 0.150 |
| 102 | VPHPDPPMAL (SEQ ID NO: 579) | 0.125 |
| 31 | RLPPSLRCSL (SEQ ID NO: 580) | 0.100 |
| 127 | PADGPSNPLC (SEQ ID NO: 581) | 0.100 |
| 44 | CCSGDPASYR (SEQ ID NO: 582) | 0.100 |
| 174 | VVSPAPSRGQ (SEQ ID NO: 583) | 0.100 |
| 15 | AVTPTCATPA (SEQ ID NO: 584) | 0.100 |
| 144 | FSTLNPVLRH (SEQ ID NO: 585) | 0.075 |
| 157 | QEAFPAHPIY (SEQ ID NO: 586) | 0.050 |

TABLE IX-continued

V4-HLA-A1-10MERS-PSCA
Each peptide is a portion of SEQ ID
NO: 8; each start position is
specified, the length of peptide is 10
amino acids, and the end position
for each peptide is the start position
plus nine.

| START | SUBSEQUENCE | SCORE |
|---|---|---|
| 21 | ATPAGPMPCS (SEQ ID NO: 587) | 0.050 |
| 158 | EAFPAHPIYD (SEQ ID NO: 588) | 0.050 |
| 16 | VTPTCATPAG (SEQ ID NO: 589) | 0.050 |
| 100 | APVPHPDPPM (SEQ ID NO: 590) | 0.050 |
| 137 | CCFHGPAFST (SEQ ID NO: 591) | 0.050 |
| 56 | GAPLQPTLGV (SEQ ID NO: 592) | 0.050 |
| 161 | PAHPIYDLSQ (SEQ ID NO: 593) | 0.050 |
| 45 | CSGDPASYRL (SEQ ID NO: 594) | 0.030 |
| 88 | AHPNASLTMY (SEQ ID NO: 595) | 0.025 |
| 145 | STLNPVLRHL (SEQ ID NO: 596) | 0.025 |
| 4 | RTTTWARRTS (SEQ ID NO: 597) | 0.025 |
| 130 | GPSNPLCCCF (SEQ ID NO: 598) | 0.025 |
| 165 | IYDLSQVWSV (SEQ ID NO: 599) | 0.025 |
| 1 | MTHRTTTWAR (SEQ ID NO: 600) | 0.025 |
| 22 | TPAGPMPCSR (SEQ ID NO: 601) | 0.025 |
| 113 | RTPTRQIGSI (SEQ ID NO: 602) | 0.025 |
| 128 | ADGPSNPLCC (SEQ ID NO: 603) | 0.025 |

TABLE IX-continued

V4-HLA-A1-10MERS-PSCA
Each peptide is a portion of SEQ ID
NO: 8; each start position is
specified, the length of peptide is 10
amino acids, and the end position
for each peptide is the start position
plus nine.

| START | SUBSEQUENCE | SCORE |
|---|---|---|
| 176 | SPAPSRGQAL (SEQ ID NO: 604) | 0.025 |
| 112 | SRTPTRQIGS (SEQ ID NO: 605) | 0.025 |
| 55 | WGAPLQPTLG (SEQ ID NO: 606) | 0.025 |
| 42 | SACCSGDPAS (SEQ ID NO: 607) | 0.020 |
| 167 | DLSQVWSVVS (SEQ ID NO: 608) | 0.020 |
| 91 | NASLTMYVCA (SEQ ID NO: 609) | 0.020 |
| 98 | VCAPVPHPDP (SEQ ID NO: 610) | 0.020 |
| 136 | CCCFHGPAFS (SEQ ID NO: 611) | 0.020 |
| 65 | WPQASVPLLJ (SEQ ID NO: 612) | 0.020 |
| 62 | TLGVVPQASV (SEQ ID NO: 613) | 0.020 |
| 93 | SLTMYVCAPV (SEQ ID NO: 614) | 0.020 |
| 177 | PAPSRGQALR (SEQ ID NO: 615) | 0.020 |
| 70 | SVPLLTHPAQ (SEQ ID NO: 616) | 0.020 |
| 131 | PSNPLCCCFH (SEQ ID NO: 617) | 0.015 |
| 175 | VSPAPSRGQA (SEQ ID NO: 618) | 0.015 |
| 38 | CSLHSACCSG (SEQ ID NO: 619) | 0.015 |
| 41 | HSACCSGDPA (SEQ ID NO: 620) | 0.015 |

TABLE IX-continued

V4-HLA-A1-10MERS-PSCA
Each peptide is a portion of SEQ ID
NO: 8; each start position is
specified, the length of peptide is 10
amino acids, and the end position
for each peptide is the start position
plus nine.

| START | SUBSEQUENCE | SCORE |
|---|---|---|
| 156 | PQEAFPAHPI (SEQ ID NO: 621) | 0.013 |
| 66 | VPQASVPLLT (SEQ ID NO: 622) | 0.013 |
| 89 | HPNASLTMYV (SEQ ID NO: 623) | 0.013 |
| 25 | GPMPCSRLPP (SEQ ID NO: 624) | 0.013 |
| 132 | SNPLCCCFHG (SEQ ID NO: 625) | 0.013 |
| 148 | NPVLRHLFPQ (SEQ ID NO: 626) | 0.013 |
| 178 | APSRGQALRR (SEQ ID NO: 627) | 0.013 |
| 37 | RCSLHSACCS (SEQ ID NO: 628) | 0.010 |
| 95 | TMYVCAPVPH (SEQ ID NO: 629) | 0.010 |
| 23 | PAGPMPCSRL (SEQ ID NO: 630) | 0.010 |
| 84 | LVPEAHPNAS (SEQ ID NO: 631) | 0.010 |
| 173 | SVVSPAPSRG (SEQ ID NO: 632) | 0.010 |
| 143 | AFSTLNPVLR (SEQ ID NO: 633) | 0.010 |
| 108 | PMALSRTPTR (SEQ ID NO: 634) | 0.010 |
| 124 | TDPPADGPSN (SEQ ID NO: 635) | 0.010 |
| 109 | MALSRTPTRQ (SEQ ID NO: 636) | 0.010 |
| 29 | CSRLPPSLRC (SEQ ID NO: 637) | 0.008 |

TABLE IX-continued

V4-HLA-A1-10MERS-PSCA
Each peptide is a portion of SEQ ID
NO: 8; each start position is
specified, the length of peptide is 10
amino acids, and the end position
for each peptide is the start position
plus nine.

| START | SUBSEQUENCE | SCORE |
|---|---|---|
| 76 | HPAQWEPVLV (SEQ ID NO: 638) | 0.005 |
| 94 | LTMYVCAPVP (SEQ ID NO: 639) | 0.005 |
| 119 | IGSIDTDPPA (SEQ ID NO: 640) | 0.005 |
| 180 | SRGQALRRAR (SEQ ID NO: 641) | 0.005 |
| 139 | FHGPAFSTLN (SEQ ID NO: 642) | 0.005 |
| 11 | RTSRAVTPTC (SEQ ID NO: 643) | 0.005 |
| 60 | QPTLGVVPQA (SEQ ID NO: 644) | 0.005 |
| 27 | MPCSRLPPSL (SEQ ID NO: 645) | 0.005 |
| 71 | VPLLTHPAQW (SEQ ID NO: 646) | 0.005 |
| 151 | LRHLFPQEAF (SEQ ID NO: 647) | 0.005 |
| 30 | SRLPPSLRCS (SEQ ID NO: 648) | 0.005 |
| 168 | LSQVWSVVSP (SEQ ID NO: 649) | 0.003 |
| 120 | GSIDTDPPAD (SEQ ID NO: 650) | 0.003 |
| 50 | ASYRLWGAPL (SEQ ID NO: 651) | 0.003 |
| 59 | LQPTLGVVPQ (SEQ ID NO: 652) | 0.003 |
| 48 | DPASYRLWGA (SEQ ID NO: 653) | 0.003 |
| 129 | DGPSNPLCCC (SEQ ID NO: 654) | 0.003 |

TABLE IX-continued

V4-HLA-A1-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 141 | GPAFSTLNPV (SEQ ID NO: 655) | 0.003 |
| 160 | FPAHPIYDLS (SEQ ID NO: 656) | 0.003 |
| 163 | HPIYDLSQVW (SEQ ID NO: 657) | 0.003 |
| 57 | APLQPTLGVV (SEQ ID NO: 658) | 0.003 |
| 18 | PTCATPAGPM (SEQ ID NO: 659) | 0.003 |
| 47 | GDPASYRLWG (SEQ ID NO: 660) | 0.003 |

TABLE IX

V19-HLA-A1-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 8 | RLLPSLRCSL (SEQ ID NO: 661) | 0.100 |
| 10 | LPSLRCSLHS (SEQ ID NO: 662) | 0.013 |
| 2 | GPMPCSRLLP (SEQ ID NO: 663) | 0.013 |
| 9 | LLPSLRCSLH (SEQ ID NO: 664) | 0.010 |
| 6 | CSRLLPSLRC (SEQ ID NO: 665) | 0.008 |
| 4 | MPCSRLLPSL (SEQ ID NO: 666) | 0.005 |
| 1 | AGPMPCSRLL (SEQ ID NO: 667) | 0.003 |

TABLE IX-continued

V19-HLA-A1-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 3 | PMPCSRLLPS (SEQ ID NO: 668) | 0.003 |
| 5 | PCSRLLPSLR (SEQ ID NO: 669) | 0.001 |
| 7 | SRLLPSLRCS (SEQ ID NO: 670) | 0.001 |

TABLE IX

V20-HLA-A1-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 4 | SGDPASSRLW (SEQ ID NO: 671) | 1.250 |
| 2 | CCSGDPASSR (SEQ ID NO: 672) | 0.100 |
| 1 | ACCSGDPASS (SEQ ID NO: 673) | 0.020 |
| 3 | CSGDPASSRL (SEQ ID NO: 674) | 0.015 |
| 8 | ASSRLWGAPL (SEQ ID NO: 675) | 0.003 |
| 9 | SSRLWGAPLQ (SEQ ID NO: 676) | 0.003 |
| 6 | DPASSRLWGA (SEQ ID NO: 677) | 0.003 |
| 5 | GDPASSRLWG (SEQ ID NO: 678) | 0.003 |
| 10 | SRLWGAPLQP (SEQ ID NO: 679) | 0.000 |
| 7 | PASSRLWGAP (SEQ ID NO: 680) | 0.000 |

TABLE IX

V21-HLA-A1-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 8 | LTDPAQWEPV (SEQ ID NO: 681) | 12.500 |
| 3 | ASVPLLTDPA (SEQ ID NO: 682) | 0.150 |
| 4 | SVPLLTDPAQ (SEQ ID NO: 683) | 0.020 |
| 5 | VPLLTDPAQW (SEQ ID NO: 684) | 0.005 |
| 10 | DPAQWEPVLV (SEQ ID NO: 685) | 0.005 |
| 7 | LLTDPAQWEP (SEQ ID NO: 686) | 0.001 |
| 9 | TDPAQWEPVL (SEQ ID NO: 687) | 0.001 |
| 2 | QASVPLLTDP (SEQ ID NO: 688) | 0.001 |
| 6 | PLLTDPAQWE (SEQ ID NO: 689) | 0.000 |
| 1 | PQASVPLLTD (SEQ ID NO: 690) | 0.000 |

TABLE IX

V21&22-HLA-A1-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 7 | LTDLAQWEPV (SEQ ID NO: 691) | 1.250 |
| 2 | ASVPLLTDLA (SEQ ID NO: 692) | 0.150 |
| 3 | SVPLLTDLAQ (SEQ ID NO: 693) | 0.050 |
| 9 | DLAQWEPVLV (SEQ ID NO: 694) | 0.020 |
| 1 | QASVPLLTDL (SEQ ID NO: 695) | 0.010 |
| 4 | VPLLTDLAQW (SEQ ID NO: 696) | 0.005 |
| 6 | LLTDLAQWEP (SEQ ID NO: 697) | 0.001 |
| 8 | TDLAQWEPVL (SEQ ID NO: 698) | 0.001 |
| 5 | PLLTDLAQWE (SEQ ID NO: 699) | 0.000 |

TABLE IX

V22-HLA-A1-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 2 | ASVPLLTHLA (SEQ ID NO: 700) | 0.150 |
| 3 | SVPLLTHLAQ (SEQ ID NO: 701) | 0.050 |
| 7 | LTHLAQWEPV (SEQ ID NO: 702) | 0.025 |
| 9 | HLAQWEPVLV (SEQ ID NO: 703) | 0.020 |
| 1 | QASYPLLTHL (SEQ ID NO: 704) | 0.010 |
| 10 | LAQWEPVLVP (SEQ ID NO: 705) | 0.005 |
| 4 | VPLLTHLAQW (SEQ ID NO: 706) | 0.005 |

TABLE IX-continued

V22-HLA-A1-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 6 | LLTHLAQWEP (SEQ ID NO: 707) | 0.001 |
| 8 | THLAQWEPVL (SEQ ID NO: 708) | 0.001 |
| 5 | PLLTHLAQWE (SEQ ID NO: 709) | 0.000 |

TABLE IX

V24-HLA-A1-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 10 | TPVPHPDPPM (SEQ ID NO: 710) | 0.050 |
| 1 | NASLTMYVCT (SEQ ID NO: 711) | 0.020 |
| 8 | VCTPVPHPDP (SEQ ID NO: 712) | 0.020 |
| 5 | TMYVCTPVPH (SEQ ID NO: 713) | 0.010 |
| 3 | SLTMYVCTPV (SEQ ID NO: 714) | 0.010 |
| 4 | LTMYVCTPVP (SEQ ID NO: 715) | 0.005 |
| 9 | CTPVPHPDPP (SEQ ID NO: 716) | 0.003 |
| 2 | ASLTMYVCTP (SEQ ID NO: 717) | 0.002 |
| 7 | YVCTPVPHPD (SEQ ID NO: 718) | 0.001 |
| 6 | MYVCTPVPHP (SEQ ID NO: 719) | 0.000 |

TABLE IX

V25-HLA-A1-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 9 | ISSIDTDPPA (SEQ ID NO: 720) | 0.030 |
| 2 | SRTPTRQISS (SEQ ID NO: 721) | 0.025 |
| 3 | RTPTRQISSI (SEQ ID NO: 722) | 0.025 |
| 10 | SSIDTDPPAD (SEQ ID NO: 723) | 0.003 |
| 1 | LSRTPTRQIS (SEQ ID NO: 724) | 0.002 |
| 5 | PTRQISSIDT (SEQ ID NO: 725) | 0.001 |
| 8 | QISSIDTDPP (SEQ ID NO: 726) | 0.001 |
| 7 | RQISSIDTDP (SEQ ID NO: 727) | 0.000 |
| 6 | TRQISSIDTD (SEQ ID NO: 728) | 0.000 |
| 4 | TPTRQISSID (SEQ ID NO: 729) | 0.000 |

TABLE IX

V25&26-HLA-A1-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 9 | ISSIDTDPPA (SEQ ID NO: 730) | 0.030 |
| 2 | SRTPTRQISS (SEQ ID NO: 731) | 0.025 |
| 3 | RTPTRQISSI (SEQ ID NO: 732) | 0.025 |

TABLE IX-continued

V25&26-HLA-A1-10MERS-PSCA
Each peptide is a portion of SEQ ID
NO: 8; each start position is
specified, the length of peptide is 10
amino acids, and the end position
for each peptide is the start position
plus nine.

| START | SUBSEQUENCE | SCORE |
|---|---|---|
| 10 | SSIDTDPPAD (SEQ ID NO: 733) | 0.003 |
| 1 | LSRTPTRQIS (SEQ ID NO: 734) | 0.002 |
| 5 | PTRQISSIDT (SEQ ID NO: 735) | 0.001 |
| 8 | QISSIDTDPP (SEQ ID NO: 736) | 0.001 |
| 9 | RQISSIDTDP (SEQ ID NO: 737) | 0.000 |
| 6 | TRQISSIDTD (SEQ ID NO: 738) | 0.000 |
| 4 | TPTRQISSID (SEQ ID NO: 739) | 0.000 |

TABLE IX

V26-HLA-A1-10MERS-PSCA
Each peptide is a portion of SEQ
ID NO: 8; each start position is
specified, the length of peptide is
10 amino acids, and the end
position for each peptide is the
start position plus nine.

| START | SUBSEQUENCE | SCORE |
|---|---|---|
| 9 | SSDTDPPADG (SEQ ID NO: 740) | 1.500 |
| 1 | RTPTRQIGSS (SEQ ID NO: 741) | 0.025 |
| 7 | IGSSDTDPPA (SEQ ID NO: 742) | 0.005 |
| 8 | GSSDTDPPAD (SEQ ID NO: 743) | 0.003 |
| 6 | QIGSSDTDPP (SEQ ID NO: 744) | 0.001 |
| 3 | PTRQIGSSDT (SEQ ID NO: 745) | 0.000 |

TABLE IX-continued

V26-HLA-A1-10MERS-PSCA
Each peptide is a portion of SEQ
ID NO: 8; each start position is
specified, the length of peptide is
10 amino acids, and the end
position for each peptide is the
start position plus nine.

| START | SUBSEQUENCE | SCORE |
|---|---|---|
| 5 | RQIGSSDTDP (SEQ ID NO: 746) | 0.000 |
| 4 | TRQIGSSDTD (SEQ ID NO: 747) | 0.000 |
| 10 | SDTDPPADGP (SEQ ID NO: 748) | 0.000 |
| 2 | TPTRQIGSSD (SEQ ID NO: 749) | 0.000 |

TABLE IX

V27-HLA-A1-10MERS-PSCA
Each peptide is a portion of SEQ
ID NO: 8; each start position is
specified, the length of peptide is
10 amino acids, and the end
position for each peptide is the
start position plus nine.

| START | SUBSEQUENCE | SCORE |
|---|---|---|
| 2 | SRGQALRRAQ (SEQ ID NO: 750) | 0.001 |
| 1 | PSRGQALRRA (SEQ ID NO: 751) | 0.000 |

TABLE X

V1-HLA-A0201-9MERS-PSCA
Each peptide is a portion of SEQ
ID NO: 2; each start position is
specified, the length of peptide is 9
amino acids, and the end position
for each peptide is the start
position plus eight.

| START | SUBSEQUENCE | SCORE |
|---|---|---|
| 43 | QLGEQCWTA (SEQ ID NO: 752) | 152.766 |
| 5 | LLALLMAGL (SEQ ID NO: 753) | 83.527 |
| 7 | ALLMAGLAL (SEQ ID NO: 754) | 79.041 |
| 109 | LLPALGLLL (SEQ ID NO: 755) | 36.316 |

TABLE X-continued

V1-HLA-A0201-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 105 | AILALLPAL (SEQ ID NO: 756) | 24.997 |
| 108 | ALLPALGLL (SEQ ID NO: 757) | 23.633 |
| 14 | ALQPGTALL (SEQ ID NO: 758) | 21.362 |
| 20 | ALLCYSCKA (SEQ ID NO: 759) | 18.382 |
| 115 | LLLWGPGQL (SEQ ID NO: 760) | 17.4681 |
| 42 | TQLGEQCWT (SEQ ID NO: 761) | 15.3751 |
| 36 | LQVENCTQL (SEQ ID NO: 762) | 15.0961 |
| 99 | ALQPAAAIL (SEQ ID NO: 763) | 8.759 |
| 58 | LLTVISKGC (SEQ ID NO: 764) | 8.446 |
| 3 | AVLLALLMA (SEQ ID NO: 765) | 3.699 |
| 30 | VSNEDCLQV (SEQ ID NO: 766) | 3.165 |
| 83 | NITCCDTDL (SEQ ID NO: 767) | 2.937 |
| 22 | LCYSCKAQV (SEQ ID NO: 768) | 2.470 |
| 78 | YVGKKNITC (SEQ ID NO: 769) | 2.000 |
| 60 | TVISKGCSL (SEQ ID NO: 770) | 1.869 |
| 107 | LALLPALGL (SEQ ID NO: 771) | 1.866 |
| 13 | LALQPGTAL (SEQ ID NO: 772) | 1.866 |
| 4 | VLLALLMAG (SEQ ID NO: 773) | 1.078 |
| 28 | AQVSNEDCL (SEQ ID NO: 774) | 1.061 |
| 15 | LQPGTALLC (SEQ ID NO: 775) | 0.856 |
| 100 | LQPAAAILA (SEQ ID NO: 776) | 0.856 |
| 12 | GLALQPGTA (SEQ ID NO: 777) | 0.646 |
| 57 | GLLTVISKG (SEQ ID NO: 778) | 0.634 |
| 71 | VDDSQDYYV (SEQ ID NO: 779) | 0.361 |
| 101 | QPAAAILAL (SEQ ID NO: 780) | 0.321 |
| 47 | QCWTARIRA (SEQ ID NO: 781) | 0.269 |
| 112 | ALGLLLWGP (SEQ ID NO: 782) | 0.257 |
| 2 | KAVLLALLM (SEQ ID NO: 783) | 0.242 |
| 63 | SKGCSLNCV (SEQ ID NO: 784) | 0.222 |
| 8 | LLMAGLALQ (SEQ ID NO: 785) | 0.216 |
| 45 | GEQCWTARI (SEQ ID NO: 786) | 0.203 |
| 11 | AGLALQPGT (SEQ ID NO: 787) | 0.180 |
| 104 | AAILALLPA (SEQ ID NO: 788) | 0.159 |
| 92 | CNASGAHAL (SEQ ID NO: 789) | 0.139 |

TABLE X-continued

V1-HLA-A0201-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 54 | RAVGLLTVI (SEQ ID NO: 790) | 0.137 |
| 106 | ILALLPALG (SEQ ID NO: 791) | 0.127 |
| 27 | KAQVSNEDC (SEQ ID NO: 792) | 0.118 |
| 1 | MKAVLLALL (SEQ ID NO: 793) | 0.116 |
| 52 | RIRAVGLLT (SEQ ID NO: 794) | 0.078 |
| 95 | SGAHALQPA (SEQ ID NO: 795) | 0.075 |
| 18 | GTALLCYSC (SEQ ID NO: 796) | 0.069 |
| 96 | GAHALQPAA (SEQ ID NO: 797) | 0.069 |
| 84 | ITCCDTDLC (SEQ ID NO: 798) | 0.057 |
| 6 | LALLMAGLA (SEQ ID NO: 799) | 0.056 |
| 114 | GLLLWGPGQ (SEQ ID NO: 800) | 0.055 |
| 91 | LCNASGAHA (SEQ ID NO: 801) | 0.055 |
| 53 | IRAVGLLTV (SEQ ID NO: 802) | 0.038 |
| 81 | KKNITCCDT (SEQ ID NO: 803) | 0.036 |
| 86 | CCDTDLCNA (SEQ ID NO: 804) | 0.030 |
| 70 | CVDDSQDYY (SEQ ID NO: 805) | 0.029 |
| 89 | TDLCNASGA (SEQ ID NO: 806) | 0.026 |
| 21 | LLCYSCKAQ (SEQ ID NO: 807) | 0.025 |
| 50 | TARIRAVGL (SEQ ID NO: 808) | 0.023 |
| 9 | LMAGLALQP (SEQ ID NO: 809) | 0.018 |
| 98 | HALQPAAAI (SEQ ID NO: 810) | 0.018 |
| 61 | VISKGCSLN (SEQ ID NO: 811) | 0.017 |
| 40 | NCTQLGEQC (SEQ ID NO: 812) | 0.016 |
| 102 | PAAAILALL (SEQ ID NO: 813) | 0.015 |
| 35 | CLQVENCTQ (SEQ ID NO: 814) | 0.015 |
| 34 | DCLQVENCT (SEQ ID NO: 815) | 0.013 |
| 67 | SLNCVDDSQ (SEQ ID NO: 816) | 0.007 |
| 48 | CWTARIRAV (SEQ ID NO: 817) | 0.004 |
| 79 | VGKKNITCC (SEQ ID NO: 818) | 0.004 |
| 10 | MAGLALQPG (SEQ ID NO: 819) | 0.004 |
| 97 | AHALQPAAA (SEQ ID NO: 820) | 0.003 |
| 55 | AVGLLTVIS (SEQ ID NO: 821) | 0.003 |
| 24 | YSCKAQVSN (SEQ ID NO: 822) | 0.002 |
| 66 | CSLNCVDDS (SEQ ID NO: 823) | 0.002 |

TABLE X-continued

V1-HLA-A0201-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 85 | TCCDTDLCN (SEQ ID NO: 824) | 0.002 |
| 69 | NCVDDSQDY (SEQ ID NO: 825) | 0.002 |
| 49 | WTARIRAVG (SEQ ID NO: 826) | 0.002 |
| 77 | YYVGKKNIT (SEQ ID NO: 827) | 0.002 |
| 62 | ISKGCSLNC (SEQ ID NO: 828) | 0.002 |
| 110 | LPALGLLLW (SEQ ID NO: 829) | 0.002 |
| 56 | VGLLTVISK (SEQ ID NO: 830) | 0.001 |
| 29 | QVSNEDCLQ (SEQ ID NO: 831) | 0.001 |
| 19 | TALLCYSCK (SEQ ID NO: 832) | 0.001 |
| 16 | QPGTALLCY (SEQ ID NO: 833) | 0.001 |
| 111 | PALGLLLWG (SEQ ID NO: 834) | 0.001 |
| 41 | CTQLGEQCW (SEQ ID NO: 835) | 0.001 |
| 51 | ARIRAVGLL (SEQ ID NO: 836) | 0.001 |
| 90 | DLCNASGAH (SEQ ID NO: 837) | 0.001 |
| 113 | LGLLLWGPG (SEQ ID NO: 838) | 0.001 |
| 33 | EDCLQVENC (SEQ ID NO: 839) | 0.001 |
| 32 | NEDCLQVEN (SEQ ID NO: 840) | 0.001 |

TABLE X-continued

V1-HLA-A0201-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 38 | VENCTQLGE (SEQ ID NO: 841) | 0.000 |
| 87 | CDTDLCNAS (SEQ ID NO: 842) | 0.000 |
| 37 | QVENCTQLG (SEQ ID NO: 843) | 0.000 |
| 76 | DYYVGKKNI (SEQ ID NO: 844) | 0.000 |
| 75 | QDYYVGKKN (SEQ ID NO: 845) | 0.000 |
| 59 | LTVISKGCS (SEQ ID NO: 846) | 0.000 |
| 103 | NASGAHALQ (SEQ ID NO: 847) | 0.000 |
| 93 | SQDYYVGKK (SEQ ID NO: 848) | 0.000 |
| 74 | NASGAHALQ (SEQ ID NO: 849) | 0.000 |
| 82 | KNITCCDTD (SEQ ID NO: 850) | 0.000 |
| 68 | LNCVDDSQD (SEQ ID NO: 851) | 0.000 |

TABLE X

V4-HLA-A0201-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 166 | YDLSQVWSV (SEQ ID NO: 852) | 28.361 |
| 146 | TLNPVLRHL (SEQ ID NO: 853) | 9.827 |

TABLE X-continued

V4-HLA-A0201-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 170 | QVWSVVSPA (SEQ ID NO: 854) | 8.298 |
| 94 | LTMYVCAPV (SEQ ID NO: 855) | 6.076 |
| 167 | DLSQVWSVV (SEQ ID NO: 856) | 3.636 |
| 65 | VVPQASVPL (SEQ ID NO: 857) | 3.178 |
| 84 | LVPEAHPNA (SEQ ID NO: 858) | 3.030 |
| 57 | APLQPTLGV (SEQ ID NO: 859) | 1.680 |
| 160 | FPAHPIYDL (SEQ ID NO: 860) | 1.475 |
| 80 | WEPVLVPEA (SEQ ID NO: 861) | 1.022 |
| 35 | SLRCSLHSA (SEQ ID NO: 862) | 0.868 |
| 63 | LGVVPQASV (SEQ ID NO: 863) | 0.772 |
| 1 | MTHRTTTWA (SEQ ID NO: 864) | 0.645 |
| 55 | WGAPLQPTL (SEQ ID NO: 865) | 0.641 |
| 66 | VPQASVPLL (SEQ ID NO: 866) | 0.545 |
| 70 | SVPLLTHPA (SEQ ID NO: 867) | 0.435 |
| 11 | RTSRAVTPT (SEQ ID NO: 868) | 0.238 |
| 32 | LPPSLRCSL (SEQ ID NO: 869) | 0.237 |
| 157 | QEAFPAHPI (SEQ ID NO: 870) | 0.203 |
| 58 | PLQPTLGVV (SEQ ID NO: 871) | 0.188 |
| 142 | PAFSTLNPV (SEQ ID NO: 872) | 0.181 |
| 92 | ASLTMYVCA (SEQ ID NO: 873) | 0.180 |
| 24 | AGPMPCSRL (SEQ ID NO: 874) | 0.139 |
| 73 | LLTHPAQWE (SEQ ID NO: 875) | 0.139 |
| 120 | GSIDTDPPA (SEQ ID NO: 876) | 0.133 |
| 139 | FHGPAFSTL (SEQ ID NO: 877) | 0.130 |
| 83 | VLVPEAHPN (SEQ ID NO: 878) | 0.127 |
| 53 | RLWGAPLQP (SEQ ID NO: 879) | 0.124 |
| 108 | PMALSRTPT (SEQ ID NO: 880) | 0.118 |
| 16 | VTPTCATPA (SEQ ID NO: 881) | 0.117 |
| 14 | RAVTPTCAT (SEQ ID NO: 882) | 0.104 |
| 130 | GPSNPLCCC (SEQ ID NO: 883) | 0.075 |
| 62 | TLGVVPQAS (SEQ ID NO: 884) | 0.075 |
| 39 | SLHSACCSG (SEQ ID NO: 885) | 0.075 |
| 21 | ATPAGPMPC (SEQ ID NO: 886) | 0.069 |
| 8 | WARRTSRAV (SEQ ID NO: 887) | 0.068 |

TABLE X-continued

V4-HLA-A0201-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 91 | NASLTMYVC (SEQ ID NO: 888) | 0.065 |
| 46 | SGDPASYRL (SEQ ID NO: 889) | 0.056 |
| 102 | VPHPDPPMA (SEQ ID NO: 890) | 0.055 |
| 90 | PNASLTMYV (SEQ ID NO: 891) | 0.055 |
| 78 | AQWEPVLVP (SEQ ID NO: 892) | 0.048 |
| 75 | THPAQWEPV (SEQ ID NO: 893) | 0.040 |
| 163 | HPIYDLSQV (SEQ ID NO: 894) | 0.036 |
| 93 | SLTMYVCAP (SEQ ID NO: 895) | 0.034 |
| 31 | RLPPSLRCS (SEQ ID NO: 896) | 0.034 |
| 154 | LFPQEAFPA (SEQ ID NO: 897) | 0.034 |
| 42 | SACCSGDPA (SEQ ID NO: 898) | 0.034 |
| 37 | RCSLHSACC (SEQ ID NO: 899) | 0.032 |
| 138 | CFHGPAFST (SEQ ID NO: 900) | 0.030 |
| 135 | LCCCFHGPA (SEQ ID NO: 901) | 0.027 |
| 49 | PASYRLWGA (SEQ ID NO: 902) | 0.026 |
| 77 | PAQWEPVLV (SEQ ID NO: 903) | 0.021 |
| 4 | RTTTWARRT (SEQ ID NO: 904) | 0.021 |

TABLE X-continued

V4-HLA-A0201-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 114 | TPTRQIGSI (SEQ ID NO: 905) | 0.020 |
| 155 | FPQEAFPAH (SEQ ID NO: 906) | 0.017 |
| 67 | PQASVPLLT (SEQ ID NO: 907) | 0.017 |
| 110 | ALSRTPTRQ (SEQ ID NO: 908) | 0.015 |
| 95 | TMYVCAPVP (SEQ ID NO: 909) | 0.014 |
| 97 | YVCAPVPHP (SEQ ID NO: 910) | 0.014 |
| 61 | PTLGVVPQA (SEQ ID NO: 911) | 0.013 |
| 174 | VVSPAPSRG (SEQ ID NO: 912) | 0.011 |
| 133 | NPLCCCFHG (SEQ ID NO: 913) | 0.010 |
| 153 | HLFPQEAFP (SEQ ID NO: 914) | 0.010 |
| 137 | CCFHGPAFS (SEQ ID NO: 915) | 0.010 |
| 101 | PVPHPDPPM (SEQ ID NO: 916) | 0.010 |
| 86 | PEAHPNASL (SEQ ID NO: 917) | 0.009 |
| 145 | STLNPVLRH (SEQ ID NO: 918) | 0.009 |
| 106 | DPPMALSRT (SEQ ID NO: 919) | 0.008 |
| 87 | EAHPNASLT (SEQ ID NO: 920) | 0.008 |
| 128 | ADGPSNPLC (SEQ ID NO: 921) | 0.007 |

TABLE X-continued

V4-HLA-A0201-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 177 | PAPSRGQAL (SEQ ID NO: 922) | 0.007 |
| 143 | AFSTLNPVL (SEQ ID NO: 923) | 0.006 |
| 72 | PLLTHPAQW (SEQ ID NO: 924) | 0.006 |
| 151 | LRHLFPQEA (SEQ ID NO: 925) | 0.004 |
| 176 | SPAPSRGQA (SEQ ID NO: 926) | 0.004 |
| 19 | TCATPAGPM (SEQ ID NO: 927) | 0.004 |
| 54 | LWGAPLQPT (SEQ ID NO: 928) | 0.004 |
| 150 | VLRHLFPQE (SEQ ID NO: 929) | 0.004 |
| 169 | SQVWSVVSP (SEQ ID NO: 930) | 0.003 |
| 88 | AHPNASLTM (SEQ ID NO: 931) | 0.003 |
| 28 | PCSRLPPSL (SEQ ID NO: 932) | 0.003 |
| 132 | SNPLCCCFH (SEQ ID NO: 933) | 0.003 |
| 74 | LTHPAQWEP (SEQ ID NO: 934) | 0.003 |
| 127 | PADGPSNPL (SEQ ID NO: 935) | 0.003 |
| 30 | SRLPPSLRC (SEQ ID NO: 936) | 0.003 |
| 12 | TSRAVTPTC (SEQ ID NO: 937) | 0.002 |
| 129 | DGPSNPLCC (SEQ ID NO: 938) | 0.002 |

TABLE X-continued

V4-HLA-A0201-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 68 | QASVPLLTH (SEQ ID NO: 939) | 0.002 |
| 172 | WSVVSPAPS (SEQ ID NO: 940) | 0.002 |
| 45 | CSGDPASYR (SEQ ID NO: 941) | 0.002 |
| 118 | QK3SIDTDP (SEQ ID NO: 942) | 0.002 |
| 76 | HPAQWEPVL (SEQ ID NO: 943) | 0.002 |
| 27 | MPCSRLPPS (SEQ ID NO: 944) | 0.002 |
| 38 | CSLHSACCS (SEQ ID NO: 945) | 0.002 |
| 111 | LSRTPTRQI (SEQ ID NO: 946) | 0.002 |
| 6 | TTWARRTSR (SEQ ID NO: 947) | 0.002 |
| 117 | RQIGSIDTD (SEQ ID NO: 948) | 0.002 |
| 149 | PVLRHLFPQ (SEQ ID NO: 949) | 0.001 |
| 103 | PHPDPPMAL (SEQ ID NO: 950) | 0.001 |
| 173 | SVVSPAPSR (SEQ ID NO: 951) | 0.001 |

TABLE X

V19-HLA-A0201-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 8 | LLPSLRCSL (SEQ ID NO: 952) | 36.316 |
| 7 | RLLPSLRCS (SEQ ID NO: 953) | 0.127 |
| 1 | PAPSRGQAL (SEQ ID NO: 954) | 0.007 |
| 4 | PCSRLLPSL (SEQ ID NO: 955) | 0.007 |
| 6 | SRLLPSLRC (SEQ ID NO: 956) | 0.003 |
| 3 | MPCSRLLPS (SEQ ID NO: 957) | 0.002 |
| 9 | LPSLRCSLH (SEQ ID NO: 958) | 0.001 |
| 2 | PMPCSRLLP (SEQ ID NO: 959) | 0.000 |
| 5 | CSRLLPSLR (SEQ ID NO: 960) | 0.000 |

TABLE X

V20-HLA-A0201-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 3 | SGDPASSRL (SEQ ID NO: 961) | 0.056 |
| 6 | PASSRLWGA (SEQ ID NO: 962) | 0.026 |
| 8 | SSRLWGAPL (SEQ ID NO: 963) | 0.011 |
| 1 | CCSGDPASS (SEQ ID NO: 964) | 0.000 |
| 2 | CSGDPASSR (SEQ ID NO: 965) | 0.000 |
| 5 | DPASSRLWG (SEQ ID NO: 966) | 0.000 |
| 7 | ASSRLWGAP (SEQ ID NO: 967) | 0.000 |
| 4 | GDPASSRLW (SEQ ID NO: 968) | 0.000 |
| 9 | SRLWGAPLQ (SEQ ID NO: 969) | 0.000 |

TABLE X

V21-HLA-A0201-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 6 | LLTDPAQWE (SEQ ID NO: 970) | 0.571 |
| 3 | SVPLLTDPA (SEQ ID NO: 971) | 0.213 |
| 8 | TDPAQWEPV (SEQ ID NO: 972) | 0.080 |
| 5 | PLLTDPAQW (SEQ ID NO: 973) | 0.006 |
| 9 | DPAQWEPVL (SEQ ID NO: 974) | 0.004 |
| 7 | LTDPAQWEP (SEQ ID NO: 975) | 0.001 |
| 4 | VPLLTDPAQ (SEQ ID NO: 976) | 0.001 |
| 1 | QASVPLLTD (SEQ ID NO: 977) | 0.000 |
| 2 | ASVPLLTDP (SEQ ID NO: 978) | 0.000 |

TABLE X

V21&22-HLA-A0201-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 8 | DLAQWEPVL (SEQ ID NO: 979) | 0.657 |
| 5 | LLTDLAQWE (SEQ ID NO: 980) | 0.571 |
| 1 | ASVPLLTDL (SEQ ID NO: 981) | 0.321 |
| 7 | TDLAQWEPV (SEQ ID NO: 982) | 0.298 |
| 2 | SVPLLTDLA (SEQ ID NO: 983) | 0.213 |
| 4 | PLLTDLAQW (SEQ ID NO: 984) | 0.014 |
| 6 | LTDLAQWEP (SEQ ID NO: 985) | 0.001 |
| 3 | VPLLTDLAQ (SEQ ID NO: 986) | 0.001 |

TABLE X

V22-HLA-A0201-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 9 | LAQWEPVLV (SEQ ID NO: 987) | 1.642 |
| 2 | SVPLLTHLA (SEQ ID NO: 988) | 0.435 |
| 1 | ASVPLLTHL (SEQ ID NO: 989) | 0.321 |
| 8 | HLAQWEPVL (SEQ ID NO: 990) | 0.298 |
| 7 | THLAQWEPV (SEQ ID NO: 991) | 0.149 |
| 5 | LLTHLAQWE (SEQ ID NO: 992) | 0.139 |
| 4 | PLLTHLAQW (SEQ ID NO: 993) | 0.014 |
| 6 | LTHLAQWEP (SEQ ID NO: 994) | 0.003 |
| 3 | VPLLTHLAQ (SEQ ID NO: 995) | 0.001 |

TABLE X

V24-HLA-A0201-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 3 | LTMYVCTPV (SEQ ID NO: 996) | 6.076 |
| 1 | ASLTMYVCT (SEQ ID NO: 997) | 0.270 |
| 2 | SLTMYVCTP (SEQ ID NO: 998) | 0.034 |
| 4 | TMYVCTPVP (SEQ ID NO: 999) | 0.014 |
| 6 | YVCTPVPHP (SEQ ID NO: 1000) | 0.014 |
| 8 | CTPVPHPDP (SEQ ID NO: 1001) | 0.000 |
| 7 | VCTPVPHPD (SEQ ID NO: 1002) | 0.000 |
| 5 | MYVCTPVPH (SEQ ID NO: 1003) | 0.000 |

TABLE X

V25-HLA-A0201-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 3 | TPTRQISSI (SEQ ID NO: 1004) | 0.157 |
| 9 | SSIDTDPPA (SEQ ID NO: 1005) | 0.133 |
| 7 | QISSIDTDP (SEQ ID NO: 1006) | 0.002 |
| 6 | RQISSIDTD (SEQ ID NO: 1007) | 0.002 |
| 5 | TRQISSIDT (SEQ ID NO: 1008) | 0.001 |
| 2 | RTPTRQISS (SEQ ID NO: 1009) | 0.001 |
| 8 | ISSIDTDPP (SEQ ID NO: 1010) | 0.000 |
| 1 | SRTPTRQIS (SEQ ID NO: 1011) | 0.000 |
| 4 | PTRQISSID (SEQ ID NO: 1012) | 0.000 |

TABLE X

V25&26-HLA-A0201-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 7 | SSSDTDPPA (SEQ ID NO: 1013) | 0.133 |
| 5 | QISSSDTDP (SEQ ID NO: 1014) | 0.002 |
| 1 | TPTRQISSS (SEQ ID NO: 1015) | 0.001 |
| 3 | TRQISSSDT (SEQ ID NO: 1016) | 0.001 |
| 4 | RQISSSDTD (SEQ ID NO: 1017) | 0.001 |
| 6 | ISSSDTPPP (SEQ ID NO: 1018) | 0.000 |
| 2 | PTRQISSSD (SEQ ID NO: 1019) | 0.000 |

TABLE X

V26-HLA-A0201-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 7 | GSSDTDPPA (SEQ ID NO: 1020) | 0.133 |
| 5 | QIGSSDTDP (SEQ ID NO: 1021) | 0.002 |
| 3 | TRQIGSSDT (SEQ ID NO: 1022) | 0.001 |
| 4 | RQIGSSDTD (SEQ ID NO: 1023) | 0.001 |
| 9 | SDTDPPADG (SEQ ID NO: 1024) | 0.000 |
| 1 | TPTRQIGSS (SEQ ID NO: 1025) | 0.000 |
| 6 | IGSSDTDPP (SEQ ID NO: 1026) | 0.000 |
| 8 | SSDTDPPAD (SEQ ID NO: 1027) | 0.000 |
| 2 | PTRQIGSSD (SEQ ID NO: 1028) | 0.000 |

TABLE X

V27-HLA-A0201-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 1 | SRGQALRRA (SEQ ID NO: 1029) | 0.000 |
| 2 | RGQALRRAQ (SEQ ID NO: 1030) | 0.000 |

TABLE XI

V1-HLA-A0201-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 4 | VLLALLMAGL (SEQ ID NO: 1031) | 309.050 |
| 21 | LLCYSCKAQV (SEQ ID NO: 1032) | 118.238 |
| 108 | ALLPALGLLL (SEQ ID NO: 1033) | 79.041 |
| 70 | CVDDSQDYYV (SEQ ID NO: 1034) | 54.894 |
| 106 | ILALLPALGL (SEQ ID NO: 1035) | 36.316 |
| 35 | CLQVENCTQL (SEQ ID NO: 1036) | 21.362 |
| 12 | GLALQPGTAL (SEQ ID NO: 1037) | 21.362 |
| 57 | GLLTVISKGC (SEQ ID NO: 1038) | 18.382 |
| 42 | TQLGEQCWTA (SEQ ID NO: 1039) | 13.978 |
| 114 | GLLLWGPGQL (SEQ ID NO: 1040) | 10.275 |
| 100 | LQPAAAILAL (SEQ ID NO: 1041) | 8.469 |
| 29 | QVSNEDCLQV (SEQ ID NO: 1042) | 6.086 |
| 99 | ALQPAAAILA (SEQ ID NO: 1043) | 4.968 |
| 14 | ALQPGTALLC (SEQ ID NO: 1044) | 4.968 |
| 78 | YVGKKNITCC (SEQ ID NO: 1045) | 4.599 |
| 6 | LALLMAGLAL (SEQ ID NO: 1046) | 1.866 |

TABLE XI-continued

V1-HLA-A0201-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 13 | LALQPGTALL (SEQ ID NO: 1047) | 1.866 |
| 47 | QCWTARIRAV (SEQ ID NO: 1048) | 1.733 |
| 52 | RIRAVGLLTV (SEQ ID NO: 1049) | 1.672 |
| 49 | WTARIRAVGL (SEQ ID NO: 1050) | 1.365 |
| 61 | VISKGCSLNC (SEQ ID NO: 1051) | 1.161 |
| 5 | LLALLMAGLA (SEQ ID NO: 1052) | 1.098 |
| 104 | AAILALLPAL (SEQ ID NO: 1053) | 0.682 |
| 41 | CTQLGEQCWT (SEQ ID NO: 1054) | 0.569 |
| 107 | LALLPALGLL (SEQ ID NO: 1055) | 0.588 |
| 2 | KAVLLALLMA (SEQ ID NO: 1056) | 0.555 |
| 27 | KAQVSNEDCL (SEQ ID NO: 1057) | 0.509 |
| 59 | LTVISKGCSL (SEQ ID NO: 1058) | 0.504 |
| 82 | KNITCCDTDL (SEQ ID NO: 1059) | 0.488 |
| 90 | DLCNASGAHA (SEQ ID NO: 1060) | 0.373 |
| 83 | NITCCDTDLC (SEQ ID NO: 1061) | 0.335 |
| 101 | QPAAAILALL (SEQ ID NO: 1062) | 0.321 |
| 85 | TCCDTDLCNA (SEQ ID NO: 1063) | 0.306 |
| 109 | LLPALGLLLW (SEQ ID NO: 1064) | 0.291 |
| 19 | TALLCYSCKA (SEQ ID NO: 1065) | 0.255 |
| 91 | LCNASGAHAL (SEQ ID NO: 1066) | 0.237 |
| 9 | LMAGLALQPG (SEQ ID NO: 1067) | 0.210 |
| 10 | MAGLALQPGT (SEQ ID NO: 1068) | 0.176 |
| 103 | AAAILALLPA (SEQ ID NO: 1069) | 0.159 |

TABLE XI-continued

V1-HLA-A0201-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 7 | ALLMAGLALQ (SEQ ID NO: 1070) | 0.127 |
| 43 | QLGEQCWTAR (SEQ ID NO: 1071) | 0.104 |
| 8 | LLMAGLALQP (SEQ ID NO: 1072) | 0.094 |
| 94 | ASGAHALQPA (SEQ ID NO: 1073) | 0.075 |
| 96 | GAHALQPAAA (SEQ ID NO: 1074) | 0.069 |
| 62 | ISKGCSLNCV (SEQ ID NO: 1075) | 0.062 |
| 3 | AVLLALLMAG (SEQ ID NO: 1076) | 0.055 |
| 20 | ALLCYSCKAQ (SEQ ID NO: 1077) | 0.055 |
| 36 | LQVENCTQLG (SEQ ID NO: 1078) | 0.053 |
| 75 | QDYYVGKKNI (SEQ ID NO: 1079) | 0.046 |
| 32 | NEDCLQVENC (SEQ ID NO: 1080) | 0.044 |
| 105 | AILALLPALG (SEQ ID NO: 1081) | 0.038 |
| 46 | EQCWTARIRA (SEQ ID NO: 1082) | 0.038 |
| 95 | SGAHALQPAA (SEQ ID NO: 1083) | 0.032 |
| 15 | LQPGTALLCY (SEQ ID NO: 1084) | 0.030 |
| 112 | ALGLLLWGPG (SEQ ID NO: 1085) | 0.016 |
| 58 | LLTVISKGCS (SEQ ID NO: 1086) | 0.016 |
| 11 | AGLALQPGTA (SEQ ID NO: 1087) | 0.016 |
| 98 | HALQPAAAIL (SEQ ID NO: 1088) | 0.015 |
| 67 | SLNCVDDSQD (SEQ ID NO: 1089) | 0.015 |
| 1 | MKAVLLALLM (SEQ ID NO: 1090) | 0.012 |
| 110 | LPALGLLLWG (SEQ ID NO: 1091) | 0.010 |
| 44 | LGEQCWTARI (SEQ ID NO: 1092) | 0.007 |
| 97 | AHALQPAAAI (SEQ ID NO: 1093) | 0.007 |
| 56 | VGLLTVISKG (SEQ ID NO: 1094) | 0.007 |
| 50 | TARIRAVGLL (SEQ ID NO: 1095) | 0.007 |
| 60 | TVISKGCSLN (SEQ ID NO: 1096) | 0.007 |
| 16 | QPGTALLCYS (SEQ ID NO: 1097) | 0.006 |
| 69 | NCVDDSQDYY (SEQ ID NO: 1098) | 0.005 |
| 26 | CKAQVSNEDC (SEQ ID NO: 1099) | 0.003 |
| 77 | YYVGKKNITC (SEQ ID NO: 1100) | 0.003 |
| 74 | SQDYYVGKKN (SEQ ID NO: 1101) | 0.003 |
| 55 | AVGLLTVISK (SEQ ID NO: 1102) | 0.003 |
| 53 | IRAVGLLTVI (SEQ ID NO: 1103) | 0.002 |
| 88 | DTDLCNASGA (SEQ ID NO: 1104) | 0.002 |
| 84 | ITCCDTDLCN (SEQ ID NO: 1105) | 0.002 |
| 28 | AQVSNEDCLQ (SEQ ID NO: 1106) | 0.002 |
| 39 | ENCTQLGEQC (SEQ ID NO: 1107) | 0.001 |
| 22 | LCYSCKAQVS (SEQ ID NO: 1108) | 0.001 |
| 51 | ARIRAVGLLT (SEQ ID NO: 1109) | 0.001 |
| 24 | YSCKAQNSNE (SEQ ID NO: 1110) | 0.001 |
| 68 | LNCVDDSQDY (SEQ ID NO: 1111) | 0.001 |
| 33 | EDCLQVENCT (SEQ ID NO: 1112) | 0.001 |
| 17 | PGTALLCYSC (SEQ ID NO: 1113) | 0.001 |
| 30 | VSNEDCLQVE (SEQ ID NO: 1114) | 0.001 |
| 113 | LGLLLWGPGQ (SEQ ID NO: 1115) | 0.001 |

TABLE XI-continued

V1-HLA-A0201-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 65 | GCSLNCVDDS (SEQ ID NO: 1116) | 0.001 |
| 40 | NCTQLGEQCW (SEQ ID NO: 1117) | 0.000 |
| 54 | RAVGLLTVIS (SEQ ID NO: 1118) | 0.000 |
| 87 | CDTDLCNASG (SEQ ID NO: 1119) | 0.000 |
| 80 | GKKNITCCDT (SEQ ID NO: 1120) | 0.000 |
| 64 | KGCSLNCVDD (SEQ ID NO: 1121) | 0.000 |
| 18 | GTALLCYSCK (SEQ ID NO: 1122) | 0.000 |
| 111 | PALGLLLWGP (SEQ ID NO: 1123) | 0.000 |
| 93 | NASGAHALQP (SEQ ID NO: 1124) | 0.000 |
| 86 | CCDTDLCNAS (SEQ ID NO: 1125) | 0.000 |
| 66 | CSLNCVDDSQ (SEQ ID NO: 1126) | 0.000 |
| 38 | VENCTQLGEQ (SEQ ID NO: 1127) | 0.000 |
| 31 | SNEDCLQVEN (SEQ ID NO: 1128) | 0.000 |
| 76 | DYYVGKKNIT (SEQ ID NO: 1129) | 0.000 |
| 92 | CNASGAHALQ (SEQ ID NO: 1130) | 0.000 |

TABLE XI

V4-HLA-A0201-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 53 | RLWGAPLQPT (SEQ ID NO: 1131) | 142.259 |
| 62 | TLGVVPQASV (SEQ ID NO: 1132) | 69.552 |

TABLE XI-continued

V4-HLA-A0201-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 93 | SLTMYVCAPV (SEQ ID NO: 1133) | 69.552 |
| 31 | RLPPSLRCSL (SEQ ID NO: 1134) | 21.362 |
| 83 | VLVPEAHPNA (SEQ ID NO: 1135) | 8.446 |
| 65 | VVPQASVPLL (SEQ ID NO: 1136) | 7.309 |
| 153 | HLFPQEAFPA (SEQ ID NO: 1137) | 3.625 |
| 150 | VLRHLFPQEA (SEQ ID NO: 1138) | 2.439 |
| 110 | ALSRTPTRQI (SEQ ID NO: 1139) | 2.087 |
| 64 | GVVPQASVPL (SEQ ID NO: 1140) | 1.869 |
| 74 | LTHPAQWEPV (SEQ ID NO: 1141) | 1.368 |
| 169 | SQVWSVVSPA (SEQ ID NO: 1142) | 1.159 |
| 166 | YDLSQVWSVV (SEQ ID NO: 1143) | 1.146 |
| 141 | GPAFSTLNPV (SEQ ID NO: 1144) | 1.044 |
| 137 | CCFHGPAFST (SEQ ID NO: 1145) | 1.044 |
| 56 | GAPLQPTLGV (SEQ ID NO: 1146) | 0.966 |
| 6 | TTWARRTSRA (SEQ ID NO: 1147) | 0.573 |
| 45 | CSGDPASYRL (SEQ ID NO: 1148) | 0.572 |
| 145 | STLNPVLRHL (SEQ ID NO: 1149) | 0.505 |

TABLE XI-continued

V4-HLA-A0201-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 50 | ASYRLWGAPL (SEQ ID NO: 1150) | 0.446 |
| 15 | AVTPTCATPA (SEQ ID NO: 1151) | 0.435 |
| 35 | SLRCSLHSAC (SEQ ID NO: 1152) | 0.378 |
| 27 | MPCSRLPPSL (SEQ ID NO: 1153) | 0.237 |
| 102 | VPHPDPPMAL (SEQ ID NO: 1154) | 0.237 |
| 57 | APLQPTLGVV (SEQ ID NO: 1155) | 0.206 |
| 73 | LLTHPAQWEP (SEQ ID NO: 1156) | 0.190 |
| 95 | TMYVCAPVPH (SEQ ID NO: 1157) | 0.172 |
| 176 | SPAPSRGQAL (SEQ ID NO: 1158) | 0.139 |
| 78 | AQWEPVLVPE (SEQ ID NO: 1159) | 0.118 |
| 165 | IYDLSQVWSV (SEQ ID NO: 1160) | 0.113 |
| 162 | AHPIYDLSQV (SEQ ID NO: 1161) | 0.111 |
| 91 | NASLTMYVCA (SEQ ID NO: 1162) | 0.104 |
| 89 | HPNASLTMYV (SEQ ID NO: 1163) | 0.085 |
| 66 | VPQASVPLLT (SEQ ID NO: 1164) | 0.083 |
| 60 | QPTLGVVPQA (SEQ ID NO: 1165) | 0.075 |
| 146 | TLNPVLRHLF (SEQ ID NO: 1166) | 0.075 |

TABLE XI-continued

V4-HLA-A0201-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 20 | CATPAGPMPC (SEQ ID NO: 1167) | 0.069 |
| 11 | RTSRAVTPTC (SEQ ID NO: 1168) | 0.069 |
| 119 | IGSIDTDPPA (SEQ ID NO: 1169) | 0.055 |
| 134 | PLCCCFHGPA (SEQ ID NO: 1170) | 0.054 |
| 84 | LVPEAHPNAS (SEQ ID NO: 1171) | 0.045 |
| 113 | RTPTRQIGSI (SEQ ID NO: 1172) | 0.043 |
| 48 | DPASYRLWGA (SEQ ID NO: 1173) | 0.042 |
| 159 | AFPAHPIYDL (SEQ ID NO: 1174) | 0.034 |
| 69 | ASVPLLTHPA (SEQ ID NO: 1175) | 0.032 |
| 100 | APVPHPDPPM (SEQ ID NO: 1176) | 0.032 |
| 138 | CFHGPAFSTL (SEQ ID NO: 1177) | 0.028 |
| 164 | PIYDLSQVWS (SEQ ID NO: 1178) | 0.016 |
| 76 | HPAQWEPVLV (SEQ ID NO: 1179) | 0.015 |
| 85 | VPEAHPNASL (SEQ ID NO: 1180) | 0.015 |
| 39 | SLHSACCSGD (SEQ ID NO: 1181) | 0.015 |
| 8 | WARRTSRAVT (SEQ ID NO: 1182) | 0.015 |
| 126 | PPADGPSNPL (SEQ ID NO: 1183) | 0.013 |

TABLE XI-continued

V4-HLA-A0201-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 170 | QVWSVVSPAP (SEQ ID NO: 1184) | 0.011 |
| 142 | PAFSTLNPVL (SEQ ID NO: 1185) | 0.010 |
| 101 | PVPHPDPPMA (SEQ ID NO: 1186) | 0.010 |
| 175 | VSPAPSRGQA (SEQ ID NO: 1187) | 0.007 |
| 155 | FPQEAFPAHP (SEQ ID NO: 1188) | 0.007 |
| 128 | ADGPSNPLCC (SEQ ID NO: 1189) | 0.007 |
| 72 | PLLTHPAQWE (SEQ ID NO: 1190) | 0.007 |
| 23 | PAGPMPCSRL (SEQ ID NO: 1191) | 0.007 |
| 173 | SVVSPAPSRG (SEQ ID NO: 1192) | 0.007 |
| 75 | THPAQWEPVL (SEQ ID NO: 1193) | 0.006 |
| 34 | PSLRCSLHSA (SEQ ID NO: 1194) | 0.006 |
| 97 | YVCAPVPHPD (SEQ ID NO: 1195) | 0.006 |
| 59 | LQPTLGVVPQ (SEQ ID NO: 1196) | 0.006 |
| 129 | DGPSNPLCCC (SEQ ID NO: 1197) | 0.006 |
| 87 | EAHPNASLTM (SEQ ID NO: 1198) | 0.005 |
| 144 | FSTLNPVLRH (SEQ ID NO: 1199) | 0.005 |
| 54 | LWGAPLQPTL (SEQ ID NO: 1200) | 0.005 |

TABLE XI-continued

V4-HLA-A0201-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 121 | SIDTDPPADG (SEQ ID NO: 1201) | 0.004 |
| 107 | PPMALSRTPT (SEQ ID NO: 1202) | 0.004 |
| 80 | WEPVLVPEAH (SEQ ID NO: 1203) | 0.003 |
| 86 | PEAHPNASLT (SEQ ID NO: 1204) | 0.003 |
| 71 | VPLLTHPAQW (SEQ ID NO: 1205) | 0.003 |
| 132 | SNPLCCCFHG (SEQ ID NO: 1206) | 0.003 |
| 26 | PMPCSRLPPS (SEQ ID NO: 1207) | 0.003 |
| 136 | CCCFHGPAFS (SEQ ID NO: 1208) | 0.003 |
| 1 | MTHRTTTWAR (SEQ ID NO: 1209) | 0.003 |
| 12 | TSRAVTPTCA (SEQ ID NO: 1210) | 0.002 |
| 29 | CSRLPPSLRC (SEQ ID NO: 1211) | 0.002 |
| 10 | RRTSRAVTPT (SEQ ID NO: 1212) | 0.002 |
| 21 | ATPAGPMPCS (SEQ ID NO: 1213) | 0.002 |
| 167 | DLSQVWSVVS (SEQ ID NO: 1214) | 0.002 |
| 55 | WGAPLQPTLG (SEQ ID NO: 1215) | 0.002 |
| 7 | TWARRTSRAV (SEQ ID NO: 1216) | 0.002 |
| 38 | CSLHSACCSG (SEQ ID NO: 1217) | 0.002 |

TABLE XI-continued

V4-HLA-A0201-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 16 | VTPTCATPAG (SEQ ID NO: 1218) | 0.002 |
| 160 | FPAHPIYDLS (SEQ ID NO: 1219) | 0.002 |
| 117 | RQIGSIDTDP (SEQ ID NO: 1220) | 0.002 |
| 156 | PQEAFPAHPI (SEQ ID NO: 1221) | 0.001 |
| 70 | SVPLLTHPAQ (SEQ ID NO: 1222) | 0.001 |
| 109 | MALSRTPTRQ (SEQ ID NO: 1223) | 0.001 |
| 148 | NPVLRHLFPQ (SEQ ID NO: 1224) | 0.001 |
| 36 | LRCSLHSACC (SEQ ID NO: 1225) | 0.001 |
| 13 | SRAVTPTCAT (SEQ ID NO: 1226) | 0.001 |
| 42 | SACCSGDPAS (SEQ ID NO: 1227) | 0.001 |
| 118 | QIGSIDTDPP (SEQ ID NO: 1228) | 0.001 |
| 147 | LNPVLRHLFP (SEQ ID NO: 1229) | 0.001 |
| 139 | FHGPAFSTLN (SEQ ID NO: 1239) | 0.001 |

TABLE XI

V19-HLA-A0201-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 8 | RLLPSLRCSL (SEQ ID NO: 1231) | 79.041 |

TABLE XI-continued

V19-HLA-A0201-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 4 | MPCSRLLPSL (SEQ ID NO: 1232) | 0.545 |
| 9 | LLPSLRCSLH (SEQ ID NO: 1233) | 0.127 |
| 1 | AGPMPCSRLL (SEQ ID NO: 1234) | 0.028 |
| 3 | PMPCSRLLPS (SEQ ID NO: 1235) | 0.003 |
| 6 | CSRLLPSLRC (SEQ ID NO: 1236) | 0.002 |
| 10 | LPSLRCSLHS (SEQ ID NO: 1237) | 0.001 |
| 2 | GPMPCSRLLP (SEQ ID NO: 1238) | 0.000 |
| 7 | SRLLPSLRCS (SEQ ID NO: 1239) | 0.000 |
| 5 | PCSRLLPSLR (SEQ ID NO: 1240) | 0.000 |

TABLE XI

V20-HLA-A0201-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 3 | CSGDPASSRL (SEQ ID NO: 1241) | 0.572 |
| 8 | ASSRLWGAPL (SEQ ID NO: 1242) | 0.139 |
| 6 | DPASSRLWGA (SEQ ID NO: 1243) | 0.042 |
| 5 | GDPASSRLWG (SEQ ID NO: 1244) | 0.001 |
| 1 | ACCSGDPASS (SEQ ID NO: 1245) | 0.000 |

TABLE XI-continued

V20-HLA-A0201-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 2 | CCSGDPASSR (SEQ ID NO: 1246) | 0.000 |
| 4 | SGDPASSRLW (SEQ ID NO: 1247) | 0.000 |
| 10 | SRLWGAPLQP (SEQ ID NO: 1248) | 0.000 |
| 9 | SSRLWGAPLQ (SEQ ID NO: 1249) | 0.000 |
| 7 | PASSRLWGAP (SEQ ID NO: 1250) | 0.000 |

TABLE XI

V21-HLA-A0201-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 7 | LLTDPAQWEP (SEQ ID NO: 1251) | 0.779 |
| 8 | LTDPAQWEPV (SEQ ID NO: 1252) | 0.547 |
| 10 | DPAQWEPVLV (SEQ ID NO: 1253) | 0.034 |
| 3 | ASVPLLTDPA (SEQ ID NO: 1254) | 0.016 |
| 9 | TDPAQWEPVL (SEQ ID NO: 1255) | 0.012 |
| 6 | PLLTDPAQWE (SEQ ID NO: 1256) | 0.007 |
| 5 | VPLLTDPAQW (SEQ ID NO: 1257) | 0.003 |
| 4 | SVPLLTDPAQ (SEQ ID NO: 1258) | 0.001 |
| 2 | QASVPLLTDP (SEQ ID NO: 1259) | 0.000 |

TABLE XI-continued

V21-HLA-A0201-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 1 | PQASVPLLTD (SEQ ID NO: 1260) | 0.000 |

TABLE XI

V21&22-HLA-A0201-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 9 | DLAQWEPVLV (SEQ ID NO: 1261) | 5.216 |
| 6 | LLTDLAQWEP (SEQ ID NO: 1262) | 0.779 |
| 1 | QASVPLLTDL (SEQ ID NO: 1263) | 0.682 |
| 7 | LTDLAQWEPV (SEQ ID NO: 1264) | 0.547 |
| 8 | TDLAQWEPVL (SEQ ID NO: 1265) | 0.045 |
| 2 | ASVPLLTDLA (SEQ ID NO: 1266) | 0.016 |
| 4 | VPLLTDLAQW (SEQ ID NO: 1267) | 0.007 |
| 5 | PLLTDLAQWE (SEQ ID NO: 1268) | 0.007 |
| 3 | SVPLLTDLAQ (SEQ ID NO: 1269) | 0.001 |

TABLE XI

V22-HLA-A0201-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 9 | HLAQWEPVLV (SEQ ID NO: 1270) | 2.365 |

TABLE XI-continued

V22-HLA-A0201-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 7 | LTHLAQWEPV (SEQ ID NO: 1271) | 1.368 |
| 1 | QASVPLLTHL (SEQ ID NO: 1272) | 0.682 |
| 6 | LLTHLAQWEP (SEQ ID NO: 1273) | 0.190 |
| 2 | ASVPLLTHLA (SEQ ID NO: 1274) | 0.032 |
| 8 | THLAWWEPVL (SEQ ID NO: 1275) | 0.023 |
| 4 | VPLLTHLAQW (SEQ ID NO: 1276) | 0.007 |
| 5 | PLLTHLAQWE (SEQ ID NO: 1277) | 0.007 |
| 3 | SVPLLTHLAQ (SEQ ID NO: 1278) | 0.001 |
| 10 | LAQWEPVLVP (SEQ ID NO: 1279) | 0.000 |

TABLE XI

V24-HLA-A0201-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 3 | SLTMYVCTPV (SEQ ID NO: 1280) | 69.552 |
| 5 | TMYVCTPVPH (SEQ ID NO: 1281) | 0.172 |
| 1 | NASLTMYVCT (SEQ ID NO: 1282) | 0.155 |
| 10 | TPVPHPDPPM (SEQ ID NO: 1283) | 0.032 |
| 7 | YVCTPVPHPD (SEQ ID NO: 1284) | 0.006 |

TABLE XI-continued

V24-HLA-A0201-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 2 | ASLTMYVCTP (SEQ ID NO: 1285) | 0.001 |
| 4 | LTMYVCTPVP (SEQ ID NO: 1286) | 0.001 |
| 8 | VCTPVPHPDP (SEQ ID NO: 1287) | 0.000 |
| 9 | CTPVPHPDPP (SEQ ID NO: 1288) | 0.000 |
| 6 | MYVCTPVPHP (SEQ ID NO: 1289) | 0.000 |

TABLE XI

V25-HLA-A0201-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 3 | RTPTRQISSI (SEQ ID NO: 1290) | 0.333 |
| 9 | ISSIDTDPPA (SEQ ID NO: 1291) | 0.055 |
| 7 | RQISSIDTDP (SEQ ID NO: 1292) | 0.002 |
| 8 | QISSIDTDPP (SEQ ID NO: 1293) | 0.001 |
| 10 | SSIDTDPPAD (SEQ ID NO: 1294) | 0.000 |
| 5 | PTRQISSIDT (SEQ ID NO: 1295) | 0.000 |
| 4 | TRTRQISSID (SEQ ID NO: 1296) | 0.000 |
| 1 | LSRTPTRQIS (SEQ ID NO: 1297) | 0.000 |

TABLE XI-continued

V25-HLA-A0201-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 2 | SRTPTRQISS (SEQ ID NO: 1298) | 0.000 |
| 6 | TRQISSIDTD (SEQ ID NO: 1299) | 0.000 |

TABLE X

V25&26-HLA-A0201-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 7 | ISSSDTDPPA (SEQ ID NO: 1300) | 0.055 |
| 1 | RTPTRQISSS (SEQ ID NO: 1301) | 0.002 |
| 5 | RQISSSDTDP (SEQ ID NO: 1302) | 0.002 |
| 6 | QISSSDTDPP (SEQ ID NO: 1303) | 0.001 |
| 8 | SSSDTDPPAD (SEQ ID NO: 1304) | 0.000 |
| 3 | PTRQISSSDT (SEQ ID NO: 1305) | 0.000 |
| 2 | TRTRQISSSD (SEQ ID NO: 1306) | 0.000 |
| 4 | TRQISSSDTD (SEQ ID NO: 1307) | 0.000 |

TABLE X

V26-HLA-A0201-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 7 | IGSSDTDPPA (SEQ ID NO: 1308) | 0.055 |
| 5 | RQIGSSDTDP (SEQ ID NO: 1309) | 0.002 |
| 6 | QIGSSDTDPP (SEQ ID NO: 1310) | 0.001 |
| 8 | GSSDTDPPAD (SEQ ID NO: 1311) | 0.000 |
| 1 | RTPTRQIGSS (SEQ ID NO: 1312) | 0.000 |
| 9 | SSDTDPPADG (SEQ ID NO: 1313) | 0.000 |
| 3 | PTRQIGSSDT (SEQ ID NO: 1314) | 0.000 |
| 2 | TRTRQIGSSD (SEQ ID NO: 1315) | 0.000 |
| 10 | SDTDPPADGP (SEQ ID NO: 1316) | 0.000 |
| 4 | TRQIGSSDTD (SEQ ID NO: 1317) | 0.000 |

TABLE X

V27-HLA-A0201-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 1 | PSRGQALRRA (SEQ ID NO: 1318) | 0.000 |
| 2 | SRGQALRRAQ (SEQ ID NO: 1319) | 0.000 |

TABLE XII

V1-HLA-A3-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 7 | ALLMAGLAL (SEQ ID NO: 1320) | 1.800 |
| 74 | SQDYYVGKK (SEQ ID NO: 1321) | 1.620 |
| 109 | LLPALGLLL (SEQ ID NO: 1322) | 1.200 |
| 5 | LLALLMAGL (SEQ ID NO: 1323) | 0.900 |
| 99 | ALQPAAAIL (SEQ ID NO: 1324) | 0.900 |
| 14 | ALQPGTALL (SEQ ID NO: 1325) | 0.900 |
| 43 | QLGEQCWTA (SEQ ID NO: 1326) | 0.900 |
| 20 | ALLCYSCKA (SEQ ID NO: 1327) | 0.900 |
| 108 | ALLPALGLL (SEQ ID NO: 1328) | 0.608 |
| 70 | CVDDSQDYY (SEQ ID NO: 1329) | 0.400 |
| 19 | TALLCYSCK (SEQ ID NO: 1330) | 0.300 |
| 115 | LLLWGPGQL (SEQ ID NO: 1331) | 0.270 |
| 114 | GLLLWGPGQ (SEQ ID NO: 1332) | 0.270 |
| 57 | GLLTVISKG (SEQ ID NO: 1333) | 0.203 |
| 56 | VGLLTVISK (SEQ ID NO: 1334) | 0.180 |
| 12 | GLALQPGTA (SEQ ID NO: 1335) | 0.180 |
| 58 | LLTVISKGC (SEQ ID NO: 1336) | 0.150 |
| 105 | AILALLPAL (SEQ ID NO: 1337) | 0.135 |
| 16 | QPGTALLCY (SEQ ID NO: 1338) | 0.120 |
| 112 | ALGLLLWGP (SEQ ID NO: 1339) | 0.090 |
| 4 | VLLALLMAG (SEQ ID NO: 1340) | 0.090 |
| 3 | AVLLALLMA (SEQ ID NO: 1341) | 0.090 |
| 60 | TVISKGCSL (SEQ ID NO: 1342) | 0.090 |
| 18 | GTALLCYSC (SEQ ID NO: 1343) | 0.090 |
| 73 | DSQDYYVGK (SEQ ID NO: 1344) | 0.090 |
| 83 | NITCCDTDL (SEQ ID NO: 1345) | 0.060 |
| 69 | NCVDDSQDY (SEQ ID NO: 1346) | 0.060 |
| 9 | LMAGLALQP (SEQ ID NO: 1347) | 0.060 |
| 8 | LLMAGLALQ (SEQ ID NO: 1348) | 0.045 |
| 36 | LQVENCTQL (SEQ ID NO: 1349) | 0.041 |
| 78 | YVGKKNITC (SEQ ID NO: 1350) | 0.040 |
| 52 | RIRAVGLLT (SEQ ID NO: 1351) | 0.030 |
| 67 | SLNCVDDSQ (SEQ ID NO: 1352) | 0.030 |
| 107 | LALLPALGL (SEQ ID NO: 1353) | 0.027 |

TABLE XII-continued

V1-HLA-A3-9MERS-PSCA
Each peptide is a portion of SEQ ID NO: 2;
each start position is specified, the
length of peptide is 9 amino acids, and
the end position for each peptide is the
start position plus eight.

| START | SUBSEQUENCE | SCORE |
|---|---|---|
| 28 | AQVSNEDCL (SEQ ID NO: 1354) | 0.027 |
| 54 | RAVGLLTVI (SEQ ID NO: 1355) | 0.020 |
| 35 | CLQVENCTQ (SEQ ID NO: 1356) | 0.020 |
| 47 | QCWTARIRA (SEQ ID NO: 1357) | 0.020 |
| 106 | ILALLPALG (SEQ ID NO: 1358) | 0.020 |
| 101 | QPAAAILAL (SEQ ID NO: 1359) | 0.018 |
| 15 | LQPGTALLC (SEQ ID NO: 1360) | 0.018 |
| 2 | KAVLLALLM (SEQ ID NO: 1361) | 0.018 |
| 90 | DLCNASGAH (SEQ ID NO: 1362) | 0.018 |
| 45 | GEQCWTARI (SEQ ID NO: 1363) | 0.016 |
| 13 | LALQPGTAL (SEQ ID NO: 1364) | 0.013 |
| 98 | HALQPAAAI (SEQ ID NO: 1365) | 0.013 |
| 100 | LQPAAAILA (SEQ ID NO: 1366) | 0.012 |
| 41 | CTQLGEQCW (SEQ ID NO: 1367) | 0.010 |
| 84 | ITCCDTDLC (SEQ ID NO: 1368) | 0.010 |
| 21 | LLCYSCKAQ (SEQ ID NO: 1369) | 0.010 |
| 22 | LCYSCKAQV (SEQ ID NO: 1370) | 0.010 |

TABLE XII-continued

V1-HLA-A3-9MERS-PSCA
Each peptide is a portion of SEQ ID NO: 2;
each start position is specified, the
length of peptide is 9 amino acids, and
the end position for each peptide is the
start position plus eight.

| START | SUBSEQUENCE | SCORE |
|---|---|---|
| 104 | AAILALLPA (SEQ ID NO: 1371) | 0.009 |
| 42 | TQLGEQCWT (SEQ ID NO: 1372) | 0.007 |
| 110 | LPALGLLLW (SEQ ID NO: 1373) | 0.006 |
| 96 | GAHALQPAA (SEQ ID NO: 1374) | 0.006 |
| 27 | KAQVSNEDC (SEQ ID NO: 1375) | 0.006 |
| 50 | TARIRAVGL (SEQ ID NO: 1376) | 0.006 |
| 55 | AVGLLTVIS (SEQ ID NO: 1377) | 0.004 |
| 44 | LGEQCWTAR (SEQ ID NO: 1378) | 0.004 |
| 46 | EQCWTARIR (SEQ ID NO: 1379) | 0.004 |
| 30 | VSNEDCLQV (SEQ ID NO: 1380) | 0.003 |
| 62 | ISKGCSLNC (SEQ ID NO: 1381) | 0.003 |
| 86 | CCDTDLCNA (SEQ ID NO: 1382) | 0.003 |
| 40 | NCQLGEQC (SEQ ID NO: 1383) | 0.002 |
| 37 | QVENCTQLG (SEQ ID NO: 1384) | 0.002 |
| 61 | VISKGCSLN (SEQ ID NO: 1385) | 0.002 |
| 91 | LCNASGAHA (SEQ ID NO: 1386) | 0.002 |
| 29 | QVSNEDCLQ (SEQ ID NO: 1387) | 0.002 |

TABLE XII-continued

V1-HLA-A3-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 49 | WTARIRAVG (SEQ ID NO: 1388) | 0.002 |
| 102 | PAAAILALL (SEQ ID NO: 1389) | 0.001 |
| 92 | CNASGAHAL (SEQ ID NO: 1390) | 0.001 |
| 1 | MKAVLLALL (SEQ ID NO: 1391) | 0.001 |
| 59 | LTVISKGCS (SEQ ID NO: 1392) | 0.001 |
| 66 | CSLNCVDDS (SEQ ID NO: 1393) | 0.001 |
| 6 | LALLMAGLA (SEQ ID NO: 1394) | 0.001 |
| 51 | ARIRAVGLL (SEQ ID NO: 1395) | 0.001 |
| 34 | DCLQVENCT (SEQ ID NO: 1396) | 0.001 |
| 25 | SCKAQVSNE (SEQ ID NO: 1397) | 0.001 |
| 71 | VDDSQDYYV (SEQ ID NO: 1398) | 0.001 |
| 53 | IRAVGLLTV (SEQ ID NO: 1399) | 0.001 |
| 65 | GCSLNCVDD (SEQ ID NO: 1400) | 0.001 |
| 76 | DYYVGKKNI (SEQ ID NO: 1401) | 0.000 |
| 103 | AAAILALLP (SEQ ID NO: 1402) | 0.000 |
| 85 | TCCDTDLCN (SEQ ID NO: 1403) | 0.000 |
| 93 | NASGAHALQ (SEQ ID NO: 1404) | 0.000 |
| 10 | MAGLALQPG (SEQ ID NO: 1405) | 0.000 |
| 79 | VGKKNITCC (SEQ ID NO: 1406) | 0.000 |
| 81 | KKNITCCDT (SEQ ID NO: 1407) | 0.000 |
| 63 | SKGCSLNCV (SEQ ID NO: 1408) | 0.000 |
| 89 | TDLCNASGA (SEQ ID NO: 1409) | 0.000 |
| 88 | DTDLCNASG (SEQ ID NO: 1410) | 0.000 |
| 95 | SGAHALQPA (SEQ ID NO: 1411) | 0.000 |
| 77 | YYVGKKNIT (SEQ ID NO: 1412) | 0.000 |
| 97 | AHALQPAAA (SEQ ID NO: 1413) | 0.000 |
| 94 | ASGAHALQP (SEQ ID NO: 1414) | 0.000 |
| 82 | KNITCCDTD (SEQ ID NO: 1415) | 0.000 |
| 33 | EDCLQVENC (SEQ ID NO: 1416) | 0.000 |
| 11 | AGLALQPGT (SEQ ID NO: 1417) | 0.000 |
| 111 | PALGLLLWG (SEQ ID NO: 1418) | 0.000 |
| 38 | VENCTQLGE (SEQ ID NO: 1419) | 0.000 |

TABLE XII

V4-HLA-A3-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 6 | TTWARRTSR (SEQ ID NO: 1420) | 1.000 |
| 173 | SVVPAPSR (SEQ ID NO: 1421) | 0.900 |
| 170 | QVWSVVSPA (SEQ ID NO: 1422) | 0.450 |
| 53 | RLWGAPLQP (SEQ ID NO: 1423) | 0.300 |
| 35 | SLRCSLHSA (SEQ ID NO: 1424) | 0.300 |
| 146 | TLNPVLRHL (SEQ ID NO: 1425) | 0.203 |
| 93 | SLTMYVCAP (SEQ ID NO: 1426) | 0.180 |
| 153 | HLFPQEAFP (SEQ ID NO: 1427) | 0.150 |
| 145 | STLNPVLRH (SEQ ID NO: 1428) | 0.135 |
| 95 | TMYVCAPVP (SEQ ID NO: 1429) | 0.100 |
| 158 | EAFPAHPIY (SEQ ID NO: 1430) | 0.090 |
| 167 | DLSQVWSVV (SEQ ID NO: 1431) | 0.090 |
| 44 | CCSGDPASY (SEQ ID NO: 1432) | 0.060 |
| 150 | VLRHLFPQE (SEQ ID NO: 1433) | 0.060 |
| 89 | HPNASLTMY (SEQ ID NO: 1434) | 0.060 |
| 65 | VVPQASVPL (SEQ ID NO: 1435) | 0.060 |
| 62 | TLGVVPQAS (SEQ ID NO: 1436) | 0.060 |

TABLE XII-continued

V4-HLA-A3-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 109 | MALSRTPTR (SEQ ID NO: 1437) | 0.060 |
| 83 | VLVPEAHPN (SEQ ID NO: 1438) | 0.045 |
| 78 | AQWEPVLVP (SEQ ID NO: 1439) | 0.041 |
| 160 | FPAHPIYDL (SEQ ID NO: 1440) | 0.041 |
| 178 | APSRGQALR (SEQ ID NO: 1441) | 0.040 |
| 29 | CSRLPPSLR (SEQ ID NO: 1442) | 0.030 |
| 84 | LVPEAHPNA (SEQ ID NO: 1443) | 0.030 |
| 72 | PLLTHPAQW (SEQ ID NO: 1444) | 0.030 |
| 45 | CSGDPASYR (SEQ ID NO: 1445) | 0.030 |
| 73 | LLTHPAQWE (SEQ ID NO: 1446) | 0.030 |
| 94 | LTMYVCAPV (SEQ ID NO: 1447) | 0.022 |
| 144 | FSTLNPVLR (SEQ ID NO: 1448) | 0.020 |
| 39 | SLHSACCSG (SEQ ID NO: 1449) | 0.020 |
| 70 | SVPLLTHPA (SEQ ID NO: 1450) | 0.020 |
| 21 | ATPAGPMPC (SEQ ID NO: 1451) | 0.020 |
| 110 | ALSRTPTRQ (SEQ ID NO: 1452) | 0.020 |
| 136 | CCCFHGPAF (SEQ ID NO: 1453) | 0.020 |

TABLE XII-continued

V4-HLA-A3-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 66 | VPQASVPLL (SEQ ID NO: 1454) | 0.018 |
| 76 | HPAQWEPVL (SEQ ID NO: 1455) | 0.018 |
| 11 | RTSRAVTPT (SEQ ID NO: 1456) | 0.015 |
| 64 | GVVPQASVP (SEQ ID NO: 1457) | 0.013 |
| 130 | GPSNPLCCC (SEQ ID NO: 1458) | 0.013 |
| 58 | PLQPTLGVV (SEQ ID NO: 1459) | 0.013 |
| 2 | THRTTTWAR (SEQ ID NO: 1460) | 0.012 |
| 61 | PTLGVVPQA (SEQ ID NO: 1461) | 0.010 |
| 164 | PIYDLSQVW (SEQ ID NO: 1462) | 0.010 |
| 16 | VTPTCATPA (SEQ ID NO: 1463) | 0.010 |
| 108 | PMALSRTPT (SEQ ID NO: 1464) | 0.010 |
| 1 | MTHRTTTWA (SEQ ID NO: 1465) | 0.010 |
| 91 | NASLTMYVC (SEQ ID NO: 1466) | 0.009 |
| 155 | FPQEAFPAH (SEQ ID NO: 1467) | 0.009 |
| 57 | APLQPTLGV (SEQ ID NO: 1468) | 0.009 |
| 97 | YVCAPVPHP (SEQ ID NO: 1469) | 0.009 |
| 68 | QASVPLLTH (SEQ ID NO: 1470) | 0.009 |
| 31 | RLPPSLRCS (SEQ ID NO: 1471) | 0.009 |
| 23 | PAGPMPCSR (SEQ ID NO: 1472) | 0.006 |
| 179 | PSRGQALRR (SEQ ID NO: 1473) | 0.006 |
| 134 | PLCCCFHGP (SEQ ID NO: 1474) | 0.006 |
| 32 | LPPSLRCSL (SEQ ID NO: 1475) | 0.006 |
| 152 | RHLFPQEAF (SEQ ID NO: 1476) | 0.005 |
| 120 | GSIDTDPPA (SEQ ID NO: 1477) | 0.005 |
| 163 | HPIYDLSQV (SEQ ID NO: 1478) | 0.005 |
| 74 | LTHPAQWEP (SEQ ID NO: 1479) | 0.005 |
| 147 | LNPVLRHLF (SEQ ID NO: 1480) | 0.004 |
| 113 | RTPTRQIGS (SEQ ID NO: 1481) | 0.004 |
| 3 | HRTTTWARR (SEQ ID NO: 1482) | 0.004 |
| 26 | PMPCSRLPP (SEQ ID NO: 1483) | 0.004 |
| 101 | PVPHPDPPM (SEQ ID NO: 1484) | 0.003 |
| 174 | WSPAPSRG (SEQ ID NO: 1485) | 0.003 |
| 118 | QIGSIDTDP (SEQ ID NO: 1486) | 0.003 |
| 15 | AVTPTCATP (SEQ ID NO: 1487) | 0.003 |

TABLE XII-continued

V4-HLA-A3-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 102 | VPHPDPPMA (SEQ ID NO: 1488) | 0.003 |
| 46 | SGDPASYRL (SEQ ID NO: 1489) | 0.003 |
| 139 | FHGPAFSTL (SEQ ID NO: 1490) | 0.003 |
| 166 | YDLSQVWSV (SEQ ID NO: 1491) | 0.003 |
| 169 | SQVWSVVSP (SEQ ID NO: 1492) | 0.003 |
| 114 | TPTRQIGSI (SEQ ID NO: 1493) | 0.003 |
| 157 | QEAFPAHPI (SEQ ID NO: 1494) | 0.003 |
| 14 | RAVTPTCAT (SEQ ID NO: 1495) | 0.002 |
| 117 | RQIGSIDTD (SEQ ID NO: 1496) | 0.002 |
| 37 | RCSLHSACC (SEQ ID NO: 1497) | 0.002 |
| 121 | SIDTDPPAD (SEQ ID NO: 1498) | 0.002 |
| 42 | SACCSGDPA (SEQ ID NO: 1499) | 0.002 |
| 137 | CCFHGPAFS (SEQ ID NO: 1500) | 0.002 |
| 51 | SYRLWGAPL (SEQ ID NO: 1501) | 0.002 |
| 135 | LCCCFHGPA (SEQ ID NO: 1502) | 0.002 |
| 80 | WEPVLVPEA (SEQ ID NO: 1503) | 0.002 |
| 131 | PSNPLCCCF (SEQ ID NO: 1504) | 0.002 |
| 4 | RTTTWARRT (SEQ ID NO: 1505) | 0.002 |
| 142 | PAFSTLNPV (SEQ ID NO: 1506) | 0.002 |
| 92 | ASLTMYVCA (SEQ ID NO: 1507) | 0.002 |
| 12 | TSRAVTPTC (SEQ ID NO: 1508) | 0.002 |
| 22 | TPAGPMPCS (SEQ ID NO: 1509) | 0.001 |
| 104 | HPDPPMALS (SEQ ID NO: 1510) | 0.001 |
| 30 | SRLPPSLRC (SEQ ID NO: 1511) | 0.001 |
| 149 | PVLRHLFPQ (SEQ ID NO: 1512) | 0.001 |
| 127 | PADGPSNPL (SEQ ID NO: 1513) | 0.001 |
| 81 | EPVLVPEAH (SEQ ID NO: 1514) | 0.001 |
| 141 | GPAFSTLNP (SEQ ID NO: 1515) | 0.001 |
| 105 | PDPPMALSR (SEQ ID NO: 1516) | 0.001 |
| 49 | PASYRLWGA (SEQ ID NO: 1517) | 0.001 |
| 55 | WGAPLQPTL (SEQ ID NO: 1518) | 0.001 |
| 24 | AGPMPCSRL (SEQ ID NO: 1519) | 0.001 |

TABLE XII

V19-A3-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 8 | LLPSLRCSL (SEQ ID NO: 1520) | 0.600 |
| 5 | CSRLLPSLR (SEQ ID NO: 1521) | 0.020 |
| 7 | RLLPSLRCS (SEQ ID NO: 1522) | 0.013 |
| 1 | GPMPCSRLL (SEQ ID NO: 1523) | 0.004 |
| 2 | PMPCSRLLP (SEQ ID NO: 1524) | 0.004 |
| 9 | LPSLRCSLH (SEQ ID NO: 1525) | 0.002 |
| 3 | MPCSRLLPS (SEQ ID NO: 1526) | 0.001 |
| 4 | PCSRLLPSL (SEQ ID NO: 1527) | 0.001 |
| 6 | SRLLPSLRC (SEQ ID NO: 1528) | 0.001 |

TABLE XII

V20-HLA-A3-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 2 | CSGDPASSR (SEQ ID NO: 1529) | 0.030 |
| 8 | SSRLWGAPL (SEQ ID NO: 1530) | 0.009 |
| 3 | SGDPASSRL (SEQ ID NO: 1531) | 0.001 |
| 6 | PASSRLWGA (SEQ ID NO: 1532) | 0.001 |
| 1 | CCSGDPASS (SEQ ID NO: 1533) | 0.001 |

TABLE XII-continued

V20-HLA-A3-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 5 | DPASSRLWG (SEQ ID NO: 1534) | 0.000 |
| 4 | GDPASSRLW (SEQ ID NO: 1535) | 0.000 |
| 9 | SRLWGAPLQ (SEQ ID NO: 1536) | 0.000 |
| 7 | ASSRLWGAP (SEQ ID NO: 1537) | 0.000 |

TABLE XII

V21-HLA-A3-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 5 | PLLTDPAQW (SEQ ID NO: 1538) | 0.030 |
| 6 | LLTDPAQWE (SEQ ID NO: 1539) | 0.030 |
| 3 | SVPLLTDPA (SEQ ID NO: 1540) | 0.020 |
| 9 | DPAQWEPVL (SEQ ID NO: 1541) | 0.005 |
| 7 | LTDPAQWEP (SEQ ID NO: 1542) | 0.005 |
| 1 | QASVPLLTD (SEQ ID NO: 1543) | 0.001 |
| 2 | ASVPLLTDP (SEQ ID NO: 1544) | 0.000 |
| 4 | VPLLTDPAQ (SEQ ID NO: 1545) | 0.000 |
| 8 | TDPAQWEPV (SEQ ID NO: 1546) | 0.000 |

TABLE XII

V21&22-HLA-A3-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 8 | DLAQWEPVL (SEQ ID NO: 1547) | 0.540 |
| 4 | PLLTDLAQW (SEQ ID NO: 1548) | 0.045 |
| 5 | LLTDLAQWE (SEQ ID NO: 1549) | 0.020 |
| 2 | SVPLLTDLA (SEQ ID NO: 1550) | 0.020 |
| 1 | ASVPLLTDL (SEQ ID NO: 1551) | 0.010 |
| 6 | LTDLAQWEP (SEQ ID NO: 1552) | 0.003 |
| 3 | VPLLTDLAQ (SEQ ID NO: 1553) | 0.001 |
| 7 | TDLAQWEPV (SEQ ID NO: 1554) | 0.000 |

TABLE XII

V22-HLA-A3-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 8 | HLAQWEPVL (SEQ ID NO: 1555) | 1.800 |
| 4 | PLLTHLAQW (SEQ ID NO: 1556) | 0.045 |
| 5 | LLTHLAQWE (SEQ ID NO: 1557) | 0.020 |
| 2 | SVPLLTHLA (SEQ ID NO: 1558) | 0.020 |
| 1 | ASVPLLTHL (SEQ ID NO: 1559) | 0.010 |
| 6 | LTHLAQWEP (SEQ ID NO: 1560) | 0.003 |
| 9 | LAQWEPVLV (SEQ ID NO: 1561) | 0.002 |
| 3 | VPLLTHLAQ (SEQ ID NO: 1562) | 0.001 |
| 7 | THLAQWEPV (SEQ ID NO: 1563) | 0.000 |

TABLE XII

V24-HLA-A3-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 2 | SLTMYVCTP (SEQ ID NO: 1564) | 0.180 |
| 4 | TMYVCTPVP (SEQ ID NO: 1565) | 0.100 |
| 3 | LTMYVCTPV (SEQ ID NO: 1566) | 0.022 |
| 6 | YVCTPVPHP (SEQ ID NO: 1567) | 0.009 |
| 8 | CTPVPHPDP (SEQ ID NO: 1568) | 0.002 |
| 1 | ASLTMYVCT (SEQ ID NO: 1569) | 0.001 |
| 7 | VCTPVPHPD (SEQ ID NO: 1570) | 0.000 |
| 5 | MYVCTPVPH (SEQ ID NO: 1571) | 0.000 |

TABLE XII

V25-HLA-A3-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 3 | TPTRQISSI (SEQ ID NO: 1572) | 0.009 |
| 2 | RTPTRQISS (SEQ ID NO: 1573) | 0.004 |
| 7 | QISSIDTDP (SEQ ID NO: 1574) | 0.003 |
| 9 | SSIDTDPPA (SEQ ID NO: 1575) | 0.002 |
| 6 | RQISSIDTD (SEQ ID NO: 1576) | 0.001 |
| 5 | TRQISSIDT (SEQ ID NO: 1577) | 0.000 |
| 4 | PTRQISSID (SEQ ID NO: 1578) | 0.000 |
| 8 | ISSIDTDPP (SEQ ID NO: 1579) | 0.000 |
| 1 | SRTPTRQIS (SEQ ID NO: 1580) | 0.000 |

TABLE XII

V25&26-HLA-A3-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 5 | QISSSDTDP (SEQ ID NO: 1581) | 0.002 |
| 7 | SSSDTDPPA (SEQ ID NO: 1582) | 0.001 |
| 4 | RQISSSDTD (SEQ ID NO: 1583) | 0.001 |
| 1 | TPTRQISSS (SEQ ID NO: 1584) | 0.001 |
| 2 | PTRQISSSD (SEQ ID NO: 1585) | 0.000 |
| 6 | ISSSDTDPP (SEQ ID NO: 1586) | 0.000 |
| 3 | TRQISSSDT (SEQ ID NO: 1587) | 0.000 |

TABLE XII

V26-HLA-A3-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 7 | GSSDTDPPA (SEQ ID NO: 1588) | 0.003 |
| 5 | QIGSSDTDP (SEQ ID NO: 1589) | 0.002 |
| 4 | RQIGSSDTD (SEQ ID NO: 1590) | 0.001 |
| 1 | TPTRQIGSS (SEQ ID NO: 1591) | 0.000 |
| 2 | PTRQIGSSD (SEQ ID NO: 1592) | 0.000 |
| 8 | SSDTDPPAD (SEQ ID NO: 1593) | 0.000 |
| 3 | TRQIGSSDT (SEQ ID NO: 1594) | 0.000 |
| 9 | SDTDPPADG (SEQ ID NO: 1595) | 0.000 |
| 6 | IGSSDTDPP (SEQ ID NO: 1596) | 0.000 |

TABLE XII

V27-HLA-A3-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 1 | SRGQALRRA (SEQ ID NO: 1597) | 0.000 |
| 2 | RGQALRRAQ (SEQ ID NO: 1598) | 0.000 |

TABLE XIII

V1-HLA-A3-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 55 | AVGLLTVISK (SEQ ID NO: 1599) | 12.000 |
| 43 | QLGEQCWTAR (SEQ ID NO: 1600) | 6.000 |
| 18 | GTALLCYSCK (SEQ ID NO: 1601) | 3.000 |
| 108 | ALLPALGLLL (SEQ ID NO: 1602) | 2.700 |
| 12 | GLALQPGTAL (SEQ ID NO: 1603) | 2.700 |
| 106 | ILALLPALGL (SEQ ID NO: 1604) | 1.800 |
| 4 | VLLALLMAGL (SEQ ID NO: 1605) | 1.350 |
| 114 | GLLLWGPGQL (SEQ ID NO: 1606) | 0.810 |
| 57 | GLLTVISKGC (SEQ ID NO: 1607) | 0.675 |
| 14 | ALQPGTALLC (SEQ ID NO: 1608) | 0.600 |
| 109 | LLPALGLLLW (SEQ ID NO: 1609) | 0.600 |
| 35 | CLQVENCTQL (SEQ ID NO: 1610) | 0.600 |

TABLE XIII-continued

V1-HLA-A3-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 99 | ALQPAAAILA (SEQ ID NO: 1611) | 0.600 |
| 15 | LQPGTALLCY (SEQ ID NO: 1612) | 0.540 |
| 21 | LLCYSCKAQV (SEQ ID NO: 1613) | 0.200 |
| 73 | DSQDYYVGKK (SEQ ID NO: 1614) | 0.081 |
| 90 | DLCNASGAHA (SEQ ID NO: 1615) | 0.060 |
| 69 | NCVDDSQDYY (SEQ ID NO: 1616) | 0.060 |
| 8 | LLMAGLALQP (SEQ ID NO: 1617) | 0.060 |
| 52 | RIRAVGLLTV (SEQ ID NO: 1618) | 0.060 |
| 5 | LLALLMAGLA (SEQ ID NO: 1619) | 0.060 |
| 70 | CVDDSQDYYV (SEQ ID NO: 1620) | 0.060 |
| 100 | LQPAAAILAL (SEQ ID NO: 1621) | 0.054 |
| 59 | LTVISKGCSL (SEQ ID NO: 1622) | 0.045 |
| 7 | ALLMAGLALQ (SEQ ID NO: 1623) | 0.045 |
| 9 | LMAGLALQPG (SEQ ID NO: 1624) | 0.045 |
| 42 | TQLGEQCWTA (SEQ ID NO: 1625) | 0.041 |
| 61 | VISKGCSLNC (SEQ ID NO: 1626) | 0.040 |
| 29 | QVSNEDCLQV (SEQ ID NO: 1627) | 0.040 |

TABLE XIII-continued

V1-HLA-A3-10MERS-PSCA
Each peptide is a portion of SEQ ID NO: 2;
each start position is specified, the
length of peptide is 10 amino acids, and
the end position for each peptide is the
start position plus nine.

| START | SUBSEQUENCE | SCORE |
|---|---|---|
| 49 | WTARIRAVGL (SEQ ID NO: 1628) | 0.030 |
| 78 | YVGKKNITCC (SEQ ID NO: 1629) | 0.030 |
| 2 | KAVLLALLMA (SEQ ID NO: 1630) | 0.027 |
| 83 | NITCCDTDLC (SEQ ID NO: 1631) | 0.020 |
| 67 | SLNCVDDSQD (SEQ ID NO: 1632) | 0.020 |
| 72 | DDSQDYYVGK (SEQ ID NO: 1633) | 0.018 |
| 6 | LALLMAGLAL (SEQ ID NO: 1634) | 0.018 |
| 27 | KAQVSNEDCL (SEQ ID NO: 1635) | 0.018 |
| 20 | ALLCYSCKAQ (SEQ ID NO: 1636) | 0.015 |
| 104 | AAILALLPAL (SEQ ID NO: 1637) | 0.013 |
| 101 | QPAAAILALL (SEQ ID NO: 1638) | 0.013 |
| 58 | LLTVISKGCS (SEQ ID NO: 1639) | 0.012 |
| 13 | LALQPGTALL (SEQ ID NO: 1640) | 0.009 |
| 19 | TALLCYSCKA (SEQ ID NO: 1641) | 0.009 |
| 98 | HALQPAAAIL (SEQ ID NO: 1642) | 0.009 |
| 3 | AVLLALLMAG (SEQ ID NO: 1643) | 0.009 |
| 68 | LNCVDDSQDY (SEQ ID NO: 1644) | 0.008 |

TABLE XIII-continued

V1-HLA-A3-10MERS-PSCA
Each peptide is a portion of SEQ ID NO: 2;
each start position is specified, the
length of peptide is 10 amino acids, and
the end position for each peptide is the
start position plus nine.

| START | SUBSEQUENCE | SCORE |
|---|---|---|
| 112 | ALGLLLWGPG (SEQ ID NO: 1645) | 0.006 |
| 96 | GAHALQPAAA (SEQ ID NO: 1646) | 0.006 |
| 103 | AAAILALLPA (SEQ ID NO: 1647) | 0.006 |
| 91 | LCNASGAHAL (SEQ ID NO: 1648) | 0.006 |
| 82 | KNITCCDTDL (SEQ ID NO: 1649) | 0.005 |
| 50 | TARIRAVGLL (SEQ ID NO: 1650) | 0.005 |
| 41 | CTQLGEQCWT (SEQ ID NO: 1651) | 0.005 |
| 107 | LALLPALGLL (SEQ ID NO: 1652) | 0.004 |
| 37 | QVENCTQLGE (SEQ ID NO: 1653) | 0.004 |
| 65 | GCSLNCVDDS (SEQ ID NO: 1654) | 0.004 |
| 45 | GEQCWTARIR (SEQ ID NO: 1655) | 0.004 |
| 46 | EQCWTARIRA (SEQ ID NO: 1656) | 0.004 |
| 88 | DTDLCNASGA (SEQ ID NO: 1657) | 0.003 |
| 105 | AILALLPALG (SEQ ID NO: 1658) | 0.003 |
| 60 | TVISKGCSLN (SEQ ID NO: 1659) | 0.003 |
| 85 | TCCDTDLCNA (SEQ ID NO: 1660) | 0.003 |
| 62 | ISKGCSLNCV (SEQ ID NO: 1661) | 0.002 |

TABLE XIII-continued

V1-HLA-A3-10MERS-PSCA
Each peptide is a portion of SEQ ID NO: 2;
each start position is specified, the
length of peptide is 10 amino acids, and
the end position for each peptide is the
start position plus nine.

| START | SUBSEQUENCE | SCORE |
|---|---|---|
| 84 | ITCCDTDLCN (SEQ ID NO: 1662) | 0.002 |
| 22 | LCYSCKAQVS (SEQ ID NO: 1663) | 0.002 |
| 40 | NCTQLGEQCW (SEQ ID NO: 1664) | 0.002 |
| 44 | LGEQCWTARI (SEQ ID NO: 1665) | 0.002 |
| 32 | NEDCLQVENC (SEQ ID NO: 1666) | 0.002 |
| 75 | QDYYVGKKNI (SEQ ID NO: 1667) | 0.002 |
| 47 | QCWTARIRAV (SEQ ID NO: 1668) | 0.002 |
| 94 | ASGAHALQPA (SEQ ID NO: 1669) | 0.002 |
| 36 | LQVENCTQLG (SEQ ID NO: 1670) | 0.001 |
| 10 | MAGLALQPGT (SEQ ID NO: 1671) | 0.001 |
| 97 | AHALQPAAAI (SEQ ID NO: 1672) | 0.001 |
| 53 | IRAVGLLTVI (SEQ ID NO: 1673) | 0.001 |
| 77 | YYVGKKNITC (SEQ ID NO: 1674) | 0.001 |
| 28 | AQVSNEDCLQ (SEQ ID NO: 1675) | 0.001 |
| 54 | RAVGLLTVIS (SEQ ID NO: 1676) | 0.001 |
| 93 | NASGAHALQP (SEQ ID NO: 1677) | 0.001 |
| 110 | LPALGLLLWG (SEQ ID NO: 1678) | 0.001 |
| 16 | QPGTALLCYS (SEQ ID NO: 1679) | 0.001 |
| 51 | ARIRAVGLLT (SEQ ID NO: 1680) | 0.000 |
| 74 | SQDYYVGKKN (SEQ ID NO: 1681) | 0.000 |
| 1 | MKAVLLALLM (SEQ ID NO: 1682) | 0.000 |
| 86 | CCDTDLCNAS (SEQ ID NO: 1683) | 0.000 |
| 80 | GKKNITCCDT (SEQ ID NO: 1684) | 0.000 |
| 25 | SCKAQVSNED (SEQ ID NO: 1685) | 0.000 |
| 24 | YSCKAQVSNE (SEQ ID NO: 1686) | 0.000 |
| 30 | VSNEDCLQVE (SEQ ID NO: 1687) | 0.000 |
| 66 | CSLNCVDDSQ (SEQ ID NO: 1688) | 0.000 |
| 111 | PALGLLLWGP (SEQ ID NO: 1689) | 0.000 |
| 26 | CKAQVSNEDC (SEQ ID NO: 1690) | 0.000 |
| 95 | SGAHALQPAA (SEQ ID NO: 1691) | 0.000 |
| 76 | DYYVGKKNIT (SEQ ID NO: 1692) | 0.000 |
| 39 | ENCTQLGEQC (SEQ ID NO: 1693) | 0.000 |
| 113 | LGLLLWGPGQ (SEQ ID NO: 1694) | 0.000 |
| 89 | TDLCNASGAH (SEQ ID NO: 1695) | 0.000 |

TABLE XIII-continued

V1-HLA-A3-10MERS-PSCA
Each peptide is a portion of SEQ ID NO: 2;
each start position is specified, the
length of peptide is 10 amino acids, and
the end position for each peptide is the
start position plus nine.

| START | SUBSEQUENCE | SCORE |
|---|---|---|
| 11 | AGLALQPGTA (SEQ ID NO: 1696) | 0.000 |
| 34 | DCLQVENCTQ (SEQ ID NO: 1697) | 0.000 |
| 56 | VGLLTVISKG (SEQ ID NO: 1698) | 0.000 |

TABLE XIII

V4-HLA-A3-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 153 | HLFPQEAFPA (SEQ ID NO: 1699) | 4.500 |
| 146 | TLNPVLRHLF (SEQ ID NO: 1700) | 3.000 |
| 53 | RLWGAPLQPT (SEQ ID NO: 1701) | 1.688 |
| 95 | TMYVCAPVPH (SEQ ID NO: 1702) | 1.000 |
| 31 | RLPPSLRCSL (SEQ ID NO: 1703) | 0.900 |
| 1 | MTHRTTTWAR (SEQ ID NO: 1704) | 0.600 |
| 150 | VLRHLFPQEA (SEQ ID NO: 1705) | 0.600 |
| 83 | VLVPEAHPNA (SEQ ID NO: 1706) | 0.450 |
| 64 | GVVPQASVPL (SEQ ID NO: 1707) | 0.405 |
| 108 | PMALSRTPTR (SEQ ID NO: 1708) | 0.400 |
| 93 | SLTMYVCAPV (SEQ ID NO: 1709) | 0.300 |

TABLE XIII-continued

V4-HLA-A3-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 62 | TLGVVPQASV (SEQ ID NO: 1710) | 0.300 |
| 5 | TTTWARRTSR (SEQ ID NO: 1711) | 0.200 |
| 35 | SLRCSLHSAC (SEQ ID NO: 1712) | 0.200 |
| 65 | VVPQASVPLL (SEQ ID NO: 1713) | 0.180 |
| 104 | HPDPPMALSR (SEQ ID NO: 1714) | 0.120 |
| 44 | CCSGDPASYR (SEQ ID NO: 1715) | 0.090 |
| 110 | ALSRTPTRQI (SEQ ID NO: 1716) | 0.090 |
| 178 | APSRGQALRR (SEQ ID NO: 1717) | 0.080 |
| 73 | LLTHPAQWEP (SEQ ID NO: 1718) | 0.060 |
| 22 | TPAGPMPCSR (SEQ ID NO: 1719) | 0.060 |
| 130 | GPSNPLCCCF (SEQ ID NO: 1720) | 0.060 |
| 6 | TTWARRTSRA (SEQ ID NO: 1721) | 0.050 |
| 172 | WSVVSPAPSR (SEQ ID NO: 1722) | 0.045 |
| 50 | ASYRLWGAPL (SEQ ID NO: 1723) | 0.045 |
| 169 | SQVWSVVSPA (SEQ ID NO: 1724) | 0.041 |
| 43 | ACCSGDPASY (SEQ ID NO: 1725) | 0.040 |
| 167 | DLSQVWSVVS (SEQ ID NO: 1726) | 0.036 |

TABLE XIII-continued

V4-HLA-A3-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 15 | AVTPTCATPA (SEQ ID NO: 1727) | 0.030 |
| 102 | VPHPDPPMAL (SEQ ID NO: 1728) | 0.027 |
| 137 | CCFHGPAFST (SEQ ID NO: 1729) | 0.022 |
| 135 | LCCCFHGPAF (SEQ ID NO: 1730) | 0.020 |
| 39 | SLHSACCSGD (SEQ ID NO: 1731) | 0.020 |
| 56 | GAPLQPTLGV (SEQ ID NO: 1732) | 0.018 |
| 134 | PLCCCFHGPA (SEQ ID NO: 1733) | 0.018 |
| 11 | RTSRAVTPTC (SEQ ID NO: 1734) | 0.015 |
| 170 | QVWSVVSPAP (SEQ ID NO: 1735) | 0.015 |
| 74 | LTHPAQWEPV (SEQ ID NO: 1736) | 0.015 |
| 113 | RTPTRQIGSI (SEQ ID NO: 1737) | 0.013 |
| 157 | QEAFPAHPY (SEQ ID NO: 1738) | 0.012 |
| 78 | AQWEPVLVPE (SEQ ID NO: 1739) | 0.010 |
| 145 | STLNPVLRHL (SEQ ID NO: 1740) | 0.010 |
| 144 | FSTLNPVLRH (SEQ ID NO: 1741) | 0.009 |
| 176 | SPAPSRGQAL (SEQ ID NO: 1742) | 0.009 |
| 85 | VPEAHPNASL (SEQ ID NO: 1743) | 0.009 |

TABLE XIII-continued

V4-HLA-A3-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 60 | QPTLGVVPQA (SEQ ID NO: 1744) | 0.009 |
| 141 | GPAFSTLNPV (SEQ ID NO: 1745) | 0.009 |
| 45 | CSGDPASYRL (SEQ ID NO: 1746) | 0.009 |
| 100 | APVPHDPPM (SEQ ID NO: 1747) | 0.007 |
| 88 | AHPNASLTMY (SEQ ID NO: 1748) | 0.006 |
| 28 | PCSRLPPSLR (SEQ ID NO: 1749) | 0.006 |
| 20 | CATPAGPMPC (SEQ ID NO: 1750) | 0.006 |
| 27 | MPCSRLPPSL (SEQ ID NO: 1751) | 0.006 |
| 84 | LVPEAHPNAS (SEQ ID NO: 1752) | 0.006 |
| 26 | PMPCSRLPPS (SEQ ID NO: 1753) | 0.006 |
| 72 | PLLTHPAQWE (SEQ ID NO: 1754) | 0.005 |
| 21 | ATPAGPMPCS (SEQ ID NO: 1755) | 0.005 |
| 159 | AFPAHPIYDL (SEQ ID NO: 1756) | 0.004 |
| 2 | THRTTTWARR (SEQ ID NO: 1757) | 0.004 |
| 143 | AFSTLNPVLR (SEQ ID NO: 1758) | 0.004 |
| 89 | HPNASLTMYV (SEQ ID NO: 1759) | 0.004 |
| 177 | PAPSRGQALR (SEQ ID NO: 1760) | 0.004 |

TABLE XIII-continued

V4-HLA-A3-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 151 | LRHLFPQEAF (SEQ ID NO: 1761) | 0.003 |
| 142 | PAFSTLNPVL (SEQ ID NO: 1762) | 0.003 |
| 66 | VPQASVPLLT (SEQ ID NO: 1763) | 0.003 |
| 173 | SVVSPAPSRG (SEQ ID NO: 1764) | 0.003 |
| 163 | HPIYDLSQVW (SEQ ID NO: 1765) | 0.003 |
| 71 | VPLLTHPAQW (SEQ ID NO: 1766) | 0.003 |
| 29 | CSRLPPSLRC (SEQ ID NO: 1767) | 0.003 |
| 97 | YVCAPVPHPD (SEQ ID NO: 1768) | 0.003 |
| 121 | SIDTDPPADG (SEQ ID NO: 1769) | 0.003 |
| 58 | PLQPTLGVVP (SEQ ID NO: 1770) | 0.003 |
| 156 | PQEAFPAHPI (SEQ ID NO: 1771) | 0.003 |
| 25 | GPMPCSRLPP (SEQ ID NO: 1772) | 0.003 |
| 138 | CFHGPAFSTL (SEQ ID NO: 1773) | 0.003 |
| 67 | PQASVPLLTH (SEQ ID NO: 1774) | 0.00 |
| 48 | DPASYRLWGA (SEQ ID NO: 1775) | 0.003 |
| 69 | ASVPLLTHPA (SEQ ID NO: 1776) | 0.002 |
| 117 | RQIGSIDTDP (SEQ ID NO: 1777) | 0.002 |
| 91 | NASLTMYVCA (SEQ ID NO: 1778) | 0.002 |
| 101 | PVPHPDPPMA (SEQ ID NO: 1779) | 0.002 |
| 32 | LPPSLRCSLH (SEQ ID NO: 1780) | 0.002 |
| 70 | SVPLLTHPAQ (SEQ ID NO: 1781) | 0.002 |
| 76 | HPAQWEPVLV (SEQ ID NO: 1782) | 0.002 |
| 118 | QIGSIDTDPP (SEQ ID NO: 1783) | 0.002 |
| 164 | PIYDLSQVWS (SEQ ID NO: 1784) | 0.002 |
| 165 | IYDLSQVWSV (SEQ ID NO: 1785) | 0.002 |
| 75 | THPAQWEPVL (SEQ ID NO: 1786) | 0.002 |
| 59 | LQPTLGVVPQ (SEQ ID NO: 1787) | 0.002 |
| 87 | EAHPNASLTM (SEQ ID NO: 1788) | 0.002 |
| 94 | LTMYVCAPVP (SEQ ID NO: 1789) | 0.002 |
| 92 | ASLTMYVCAP (SEQ ID NO: 1790) | 0.001 |
| 148 | NPVLRHLFPQ (SEQ ID NO: 1791) | 0.001 |
| 23 | PAGPMPCSRL (SEQ ID NO: 1792) | 0.001 |
| 57 | APLQPTLGVV (SEQ ID NO: 1793) | 0.001 |
| 16 | VTPTCATPAG (SEQ ID NO: 1794) | 0.001 |

TABLE XIII-continued

V4-HLA-A3-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 41 | HSACCSGDPA (SEQ ID NO: 1795) | 0.001 |
| 115 | PTRQIGSIDT (SEQ ID NO: 1796) | 0.001 |
| 12 | TSRAVTPTCA (SEQ ID NO: 1797) | 0.001 |
| 8 | WARRTSRAVT (SEQ ID NO: 1798) | 0.001 |

TABLE XIII

V19-HLA-A3-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 8 | RLLPSLRCSL (SEQ ID NO: 1799) | 1.350 |
| 9 | LLPSLRCSLH (SEQ ID NO: 1800) | 0.200 |
| 3 | PMPCSRLLPS (SEQ ID NO: 1801) | 0.012 |
| 4 | MPCSRLLPSL (SEQ ID NO: 1802) | 0.009 |
| 5 | PCSRLLPSLR (SEQ ID NO: 1803) | 0.004 |
| 6 | CSRLLPSLRC (SEQ ID NO: 1804) | 0.003 |
| 2 | GPMPCSRLLP (SEQ ID NO: 1805) | 0.003 |
| 10 | LPSLRCSLHS (SEQ ID NO: 1806) | 0.001 |
| 1 | AGPMPCSRLL (SEQ ID NO: 1807) | 0.000 |
| 7 | SRLLPSLRCS (SEQ ID NO: 1808) | 0.000 |

TABLE XIII

V20-HLA-A3-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 2 | CCSGDPASSR (SEQ ID NO: 1809) | 0.090 |
| 8 | ASSRLWGAPL (SEQ ID NO: 1810) | 0.009 |
| 3 | CSGDPASSRL (SEQ ID NO: 1811) | 0.003 |
| 6 | DPASSRLWGA (SEQ ID NO: 1812) | 0.003 |
| 1 | ACCSGDPASS (SEQ ID NO: 1813) | 0.000 |
| 5 | GDPASSRLWG (SEQ ID NO: 1814) | 0.000 |
| 9 | SSRLWGAPLQ (SEQ ID NO: 1815) | 0.000 |
| 10 | SRLWGAPLQP (SEQ ID NO: 1816) | 0.000 |
| 4 | SGDPASSRLW (SEQ ID NO: 1817) | 0.000 |
| 7 | PASSRLWGAP (SEQ ID NO: 1818) | 0.000 |

TABLE XIII

V21&22-HLA-A3-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 7 | LTDLAQWEPV (SEQ ID NO: 1819) | 0.010 |
| 3 | SVPLLTDLAQ (SEQ ID NO: 1820) | 0.004 |
| 4 | VPLLTDLAQW (SEQ ID NO: 1821) | 0.003 |
| 1 | QASVPLLTDL (SEQ ID NO: 1822) | 0.002 |

TABLE XIII-continued

V21&22-HLA-A3-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 9 | DLAQWEPVLV (SEQ ID NO: 1823) | 0.001 |
| 6 | LLTDLAQWEP (SEQ ID NO: 1824) | 0.001 |
| 8 | TDLAQWEPVL (SEQ ID NO: 1825) | 0.000 |
| 2 | ASVPLLTDLA (SEQ ID NO: 1826) | 0.000 |
| 5 | PLLTDLAQWE (SEQ ID NO: 1827) | 0.000 |

TABLE XIII

V22-HLA-A3-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 9 | HLAQWEPVLV (SEQ ID NO: 1828) | 0.200 |
| 6 | LLTHLAQWEP (SEQ ID NO: 1829) | 0.060 |
| 7 | LTHLAQWEPV (SEQ ID NO: 1830) | 0.010 |
| 1 | QASVPLLTHL (SEQ ID NO: 1831) | 0.009 |
| 4 | VPLLTHLAQW (SEQ ID NO: 1832) | 0.005 |
| 3 | SVPLLTHLAQ (SEQ ID NO: 1833) | 0.004 |
| 5 | PLLTHLAQWE (SEQ ID NO: 1834) | 0.003 |
| 8 | THLAQWEPVL (SEQ ID NO: 1835) | 0.003 |
| 2 | ASVPLLTHLA (SEQ ID NO: 1836) | 0.002 |

TABLE XIII-continued

V22-HLA-A3-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 10 | LAQWEPVLVP (SEQ ID NO: 1837) | 0.002 |

TABLE XIII

V24-HLA-A3-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 5 | TMYVCTPVPH (SEQ ID NO: 1838) | 1.000 |
| 3 | SLTMYVCTPV (SEQ ID NO: 1839) | 0.300 |
| 10 | TPVPHPDPPM (SEQ ID NO: 1840) | 0.007 |
| 7 | YVCTPVPHPD (SEQ ID NO: 1841) | 0.003 |
| 4 | LTMYVCTPVP (SEQ ID NO: 1842) | 0.002 |
| 2 | ASLTMYVCTP (SEQ ID NO: 1843) | 0.001 |
| 9 | CTPVPHPDPP (SEQ ID NO: 1844) | 0.001 |
| 1 | NASLTMYVCT (SEQ ID NO: 1845) | 0.001 |
| 8 | VCTPVPHPDP (SEQ ID NO: 1846) | 0.000 |
| 6 | MYVCTPVPHP (SEQ ID NO: 1847) | 0.000 |

TABLE XIII

V25-HLA-A3-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 3 | RTPTRQISSI (SEQ ID NO: 1848) | 0.045 |
| 8 | QISSIDTDPP (SEQ ID NO: 1849) | 0.002 |
| 7 | RQISSIDTDP (SEQ ID NO: 1850) | 0.001 |
| 9 | ISSIDTDPPA (SEQ ID NO: 1851) | 0.001 |
| 5 | PTRQISSIDT (SEQ ID NO: 1852) | 0.001 |
| 4 | TPTRQISSID (SEQ ID NO: 1853) | 0.000 |
| 1 | LSRTPTRQIS (SEQ ID NO: 1854) | 0.000 |
| 10 | SSIDTDPPAD (SEQ ID NO: 1855) | 0.000 |
| 2 | SRTPTRQISS (SEQ ID NO: 1856) | 0.000 |
| 6 | TRQISSIDTD (SEQ ID NO: 1857) | 0.000 |

TABLE XIII

V25&26-HLA-A3-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 1 | RTPTRQISSS (SEQ ID NO: 1858) | 0.003 |
| 6 | QISSSDTDPP (SEQ ID NO: 1859) | 0.002 |
| 7 | ISSSDTDPPA (SEQ ID NO: 1860) | 0.001 |
| 5 | RQISSSDTDP (SEQ ID NO: 1861) | 0.001 |

TABLE XIII-continued

V25&26-HLA-A3-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 3 | PTRQISSSDT (SEQ ID NO: 1862) | 0.001 |
| 2 | TPTRQISSSD (SEQ ID NO: 1863) | 0.000 |
| 8 | SSSDTDPPAD (SEQ ID NO: 1864) | 0.000 |
| 4 | TRQISSSDTD (SEQ ID NO: 1865) | 0.000 |

TABLE XIII

V26-HLA-A3-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 6 | QIGSSDTDPP (SEQ ID NO: 1866) | 0.002 |
| 5 | RQIGSSDTDP (SEQ ID NO: 1867) | 0.001 |
| 1 | RTPTRQIGSS (SEQ ID NO: 1868) | 0.001 |
| 3 | PTRQIGSSDT (SEQ ID NO: 1869) | 0.001 |
| 8 | GSSDTDPPAD (SEQ ID NO: 1870) | 0.000 |
| 2 | TPTRQIGSSD (SEQ ID NO: 1871) | 0.000 |
| 7 | IGSSDTDPPA (SEQ ID NO: 1872) | 0.000 |
| 9 | SSDTDPPADG (SEQ ID NO: 1873) | 0.000 |
| 10 | SDTDPPADGP (SEQ ID NO: 1874) | 0.000 |
| 4 | TRQIGSSDTD (SEQ ID NO: 1875) | 0.000 |

TABLE XIII

V27-HLA-A3-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 1 | PSRGQALRRA (SEQ ID NO: 1876) | 0.000 |
| 2 | SRGQALRRAQ (SEQ ID NO: 1877) | 0.000 |

TABLE XIV

V1-HLA-A1101-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 74 | SQDYYVGKK (SEQ ID NO: 1878) | 0.600 |
| 19 | TALLCYSCK (SEQ ID NO: 1879) | 0.300 |
| 56 | VGLLTVISK (SEQ ID NO: 1880) | 0.060 |
| 3 | AVLLALLMA (SEQ ID NO: 1881) | 0.060 |
| 60 | TVISKGCSL (SEQ ID NO: 1882) | 0.030 |
| 70 | CVDDSQDYY (SEQ ID NO: 1883) | 0.020 |
| 2 | KAVLLALLM (SEQ ID NO: 1884) | 0.018 |
| 12 | GLALQPGTA (SEQ ID NO: 1885) | 0.012 |
| 7 | ALLMAGLAL (SEQ ID NO: 1886) | 0.012 |
| 100 | LQPAAAILA (SEQ ID NO: 1887) | 0.012 |
| 41 | CTQLGEQCW (SEQ ID NO: 1888) | 0.010 |
| 36 | LQVENCTQL (SEQ ID NO: 1889) | 0.009 |
| 28 | AQVSNEDCL (SEQ ID NO: 1890) | 0.009 |
| 54 | RAVGLLTVI (SEQ ID NO: 1891) | 0.009 |
| 47 | QCWTARIRA (SEQ ID NO: 1892) | 0.008 |
| 43 | QLGEQCWTA (SEQ ID NO: 1893) | 0.008 |
| 109 | LLPALGLLL (SEQ ID NO: 1894) | 0.008 |
| 108 | ALLPALGLL (SEQ ID NO: 1895) | 0.006 |
| 73 | DSQDYYVGK (SEQ ID NO: 1896) | 0.006 |
| 115 | LLLWGPGQL (SEQ ID NO: 1897) | 0.006 |
| 107 | LALLPALGL (SEQ ID NO: 1898) | 0.006 |
| 104 | AAILALLPA (SEQ ID NO: 1899) | 0.006 |
| 20 | ALLCYSCKA (SEQ ID NO: 1900) | 0.006 |
| 96 | GAHALQPAA (SEQ ID NO: 1901) | 0.006 |
| 18 | GTALLCYSC (SEQ ID NO: 1902) | 0.006 |
| 105 | AILALLPAL (SEQ ID NO: 1903) | 0.006 |
| 5 | LLALLMAGL (SEQ ID NO: 1904) | 0.004 |
| 44 | LGEQCWTAR (SEQ ID NO: 1905) | 0.004 |
| 83 | NITCCDTDL (SEQ ID NO: 1906) | 0.004 |

TABLE XIV-continued

V1-HLA-A1101-9MERS-PSCA
Each peptide is a portion of SEQ ID NO: 2;
each start position is specified, the
length of peptide is 9 amino acids, and
the end position for each peptide is the
start position plus eight.

| START | SUBSEQUENCE | SCORE |
|---|---|---|
| 22 | LCYSCKAQV (SEQ ID NO: 1907) | 0.004 |
| 110 | LPALGLLLW (SEQ ID NO: 1908) | 0.004 |
| 99 | ALQPAAAIL (SEQ ID NO: 1909) | 0.004 |
| 101 | QPAAAILAL (SEQ ID NO: 1910) | 0.004 |
| 78 | YVGKKNITC (SEQ ID NO: 1911) | 0.004 |
| 14 | ALQPGTALL (SEQ ID NO: 1912) | 0.004 |
| 16 | QPGTALLCY (SEQ ID NO: 1913) | 0.004 |
| 46 | EQCWTARIR (SEQ ID NO: 1914) | 0.004 |
| 13 | LALQPGTAL (SEQ ID NO: 1915) | 0.003 |
| 6 | LALLMAGLA (SEQ ID NO: 1916) | 0.003 |
| 69 | NCVDDSQDY (SEQ ID NO: 1917) | 0.003 |
| 98 | HALQPAAAI (SEQ ID NO: 1918) | 0.003 |
| 52 | RIRAVGLLT (SEQ ID NO: 1919) | 0.002 |
| 29 | QVSNEDCLQ (SEQ ID NO: 1920) | 0.002 |
| 91 | LCNASGAHA (SEQ ID NO: 1921) | 0.002 |
| 50 | TARIRAVGL (SEQ ID NO: 1922) | 0.002 |
| 55 | AVGLLTVIS (SEQ ID NO: 1923) | 0.002 |
| 37 | QVENCTQLG (SEQ ID NO: 1924) | 0.002 |
| 86 | CCDTDLCNA (SEQ ID NO: 1925) | 0.002 |
| 57 | GLLTVISKG (SEQ ID NO: 1926) | 0.002 |
| 114 | GLLLWGPGQ (SEQ ID NO: 1927) | 0.002 |
| 45 | GEQCWTARI (SEQ ID NO: 1928) | 0.002 |
| 59 | LTVISKGCS (SEQ ID NO: 1929) | 0.002 |
| 4 | VLLALLMAG (SEQ ID NO: 1930) | 0.001 |
| 15 | LQPGTALLC (SEQ ID NO: 1931) | 0.001 |
| 90 | DLCNASGAH (SEQ ID NO: 1932) | 0.001 |
| 76 | DYYVGKKNI (SEQ ID NO: 1933) | 0.001 |
| 84 | ITCCDTDLC (SEQ ID NO: 1934) | 0.001 |
| 49 | WTARIRAVG (SEQ ID NO: 1935) | 0.001 |
| 42 | TQLGEQCWT (SEQ ID NO: 1936) | 0.001 |
| 112 | ALGLLLWGP (SEQ ID NO: 1937) | 0.001 |
| 9 | LMAGLALQP (SEQ ID NO: 1938) | 0.001 |
| 8 | LLMAGLALQ (SEQ ID NO: 1939) | 0.001 |
| 77 | YVGKKNIT (SEQ ID NO: 1940) | 0.001 |

TABLE XIV-continued

V1-HLA-A1101-9MERS-PSCA
Each peptide is a portion of SEQ ID NO: 2;
each start position is specified, the
length of peptide is 9 amino acids, and
the end position for each peptide is the
start position plus eight.

| START | SUBSEQUENCE | SCORE |
|---|---|---|
| 65 | GCSLNCVDD (SEQ ID NO: 1941) | 0.001 |
| 27 | KAQVSNEDC (SEQ ID NO: 1942) | 0.001 |
| 30 | VSNEDCLQV (SEQ ID NO: 1943) | 0.000 |
| 35 | CLQVENCTQ (SEQ ID NO: 1944) | 0.000 |
| 71 | VDDSQDYYV (SEQ ID NO: 1945) | 0.000 |
| 61 | VISKGCSLN (SEQ ID NO: 1946) | 0.000 |
| 106 | ILALLPALG (SEQ ID NO: 1947) | 0.000 |
| 85 | TCCDTDLCN (SEQ ID NO: 1948) | 0.000 |
| 92 | CNASGAHAL (SEQ ID NO: 1949) | 0.000 |
| 53 | IRAVGLLTV (SEQ ID NO: 1950) | 0.000 |
| 23 | CYSCKAQVS (SEQ ID NO: 1951) | 0.000 |
| 67 | SLNCVDDSQ (SEQ ID NO: 1952) | 0.000 |
| 103 | AAAILALLP (SEQ ID NO: 1953) | 0.000 |
| 89 | TDLCNASGA (SEQ ID NO: 1954) | 0.000 |
| 88 | DTDLCNASG (SEQ ID NO: 1955) | 0.000 |
| 51 | ARIRAVGLL (SEQ ID NO: 1956) | 0.000 |
| 58 | LLTVISKGC (SEQ ID NO: 1957) | 0.000 |

TABLE XIV-continued

V1-HLA-A1101-9MERS-PSCA
Each peptide is a portion of SEQ ID NO: 2;
each start position is specified, the
length of peptide is 9 amino acids, and
the end position for each peptide is the
start position plus eight.

| START | SUBSEQUENCE | SCORE |
|---|---|---|
| 40 | NCTQLGEQC (SEQ ID NO: 1958) | 0.000 |
| 63 | SKGCSLNCV (SEQ ID NO: 1959) | 0.000 |
| 93 | NASGAHALQ (SEQ ID NO: 1960) | 0.000 |
| 10 | MAGLALQPG (SEQ ID NO: 1961) | 0.000 |
| 21 | LLCYSCKAQ (SEQ ID NO: 1962) | 0.000 |
| 25 | SCKAQVSNE (SEQ ID NO: 1963) | 0.000 |
| 95 | SGAHALQPA (SEQ ID NO: 1964) | 0.000 |
| 1 | MKAVLLALL (SEQ ID NO: 1965) | 0.000 |
| 97 | AHALQPAAA (SEQ ID NO: 1966) | 0.000 |
| 102 | PAAAILALL (SEQ ID NO: 1967) | 0.000 |
| 82 | KNITCCDTD (SEQ ID NO: 1968) | 0.000 |
| 38 | VENCTQLGE (SEQ ID NO: 1969) | 0.000 |
| 34 | DCLQVENCT (SEQ ID NO: 1970) | 0.000 |
| 80 | GKKNITCCD (SEQ ID NO: 1971) | 0.000 |
| 64 | KGCSLNCVD (SEQ ID NO: 1972) | 0.000 |
| 111 | PALGLLLWG (SEQ ID NO: 1973) | 0.000 |
| 81 | KKNITCCDT (SEQ ID NO: 1974) | 0.000 |

TABLE XIV-continued

V1-HLA-A1101-9MERS-PSCA

Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 32 | NEDCLQVEN (SEQ ID NO: 1975) | 0.000 |
| 68 | LNCVDDSQD (SEQ ID NO: 1976) | 0.000 |
| 94 | ASGAHALQP (SEQ ID NO: 1977) | 0.000 |

TABLE XIV

V4-HLA-A1101-9MERS-PSCA

Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 173 | SVVSPAPSR (SEQ ID NO: 1978) | 0.600 |
| 6 | TTWARRTSR (SEQ ID NO: 1979) | 0.400 |
| 109 | MALSRTPTR (SEQ ID NO: 1980) | 0.060 |
| 178 | APSRGQALR (SEQ ID NO: 1981) | 0.040 |
| 170 | QVWSVVSPA (SEQ ID NO: 1982) | 0.040 |
| 145 | STLNPVLRH (SEQ ID NO: 1983) | 0.030 |
| 84 | LVPEAHPNA (SEQ ID NO: 1984) | 0.020 |
| 94 | LTMYVCAPV (SEQ ID NO: 1985) | 0.020 |
| 65 | VVPQASVPL (SEQ ID NO: 1986) | 0.020 |
| 70 | SVPLLTHPA (SEQ ID NO: 1987) | 0.020 |
| 16 | VTPTCATPA (SEQ ID NO: 1988) | 0.010 |

TABLE XIV-continued

V4-HLA-A1101-9MERS-PSCA

Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 1 | MTHRTTTWA (SEQ ID NO: 1989) | 0.010 |
| 64 | GVVPQASVP (SEQ ID NO: 1990) | 0.009 |
| 2 | THRTTTWAR (SEQ ID NO: 1991) | 0.008 |
| 154 | LFPQEAFPA (SEQ ID NO: 1992) | 0.006 |
| 113 | RTPTRQIGS (SEQ ID NO: 1993) | 0.006 |
| 57 | APLQPTLGV (SEQ ID NO: 1994) | 0.006 |
| 96 | MYVCAPVPH (SEQ ID NO: 1995) | 0.006 |
| 53 | RLWGAPLQP (SEQ ID NO: 1996) | 0.005 |
| 3 | HRTTTWARR (SEQ ID NO: 1997) | 0.004 |
| 68 | QASVPLLTH (SEQ ID NO: 1998) | 0.004 |
| 160 | FPAHPIYDL (SEQ ID NO: 1999) | 0.004 |
| 51 | SYRLWGAPL (SEQ ID NO: 2000) | 0.004 |
| 29 | CSRLPPSLR (SEQ ID NO: 2001) | 0.004 |
| 23 | PAGPMPCSR (SEQ ID NO: 2002) | 0.004 |
| 45 | CSGDPASYR (SEQ ID NO: 2003) | 0.004 |
| 144 | FSTLNPVLR (SEQ ID NO: 2004) | 0.004 |
| 35 | SLRCSLHSA (SEQ ID NO: 2005) | 0.004 |

TABLE XIV-continued

V4-HLA-A1101-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 11 | RTSRAVTPT (SEQ ID NO: 2006) | 0.003 |
| 163 | HPIYDLSQV (SEQ ID NO: 2007) | 0.003 |
| 117 | RQIGSIDTD (SEQ ID NO: 2008) | 0.003 |
| 78 | AQWEPVLVP (SEQ ID NO: 2009) | 0.002 |
| 114 | TPTRQIGSI (SEQ ID NO: 2010) | 0.002 |
| 15 | AVTPTCATP (SEQ ID NO: 2011) | 0.002 |
| 19 | TCATPAGPM (SEQ ID NO: 2012) | 0.002 |
| 32 | LPPSLRCSL (SEQ ID NO: 2013) | 0.002 |
| 97 | YVCAPVPHP (SEQ ID NO: 2014) | 0.002 |
| 66 | VPQASVPLL (SEQ ID NO: 2015) | 0.002 |
| 42 | SACCSGDPA (SEQ ID NO: 2016) | 0.002 |
| 74 | LTHPAQWEP (SEQ ID NO: 2017) | 0.002 |
| 143 | AFSTLNPVL (SEQ ID NO: 2018) | 0.002 |
| 102 | VPHPDPPMA (SEQ ID NO: 2019) | 0.002 |
| 89 | HPNASLTMY (SEQ ID NO: 2020) | 0.002 |
| 176 | SPAPSRGQA (SEQ ID NO: 2021) | 0.002 |
| 101 | PVPHPDPPM (SEQ ID NO: 2022) | 0.002 |
| 76 | HPAQWEPVL (SEQ ID NO: 2023) | 0.002 |
| 135 | LCCCFHGPA (SEQ ID NO: 2024) | 0.002 |
| 44 | CCSGDPASY (SEQ ID NO: 2025) | 0.002 |
| 21 | ATPAGPMPC (SEQ ID NO: 2026) | 0.002 |
| 136 | CCCFHGPAF (SEQ ID NO: 2027) | 0.002 |
| 155 | FPQEAFPAH (SEQ ID NO: 2028) | 0.002 |
| 174 | VVSPAPSRG (SEQ ID NO: 2029) | 0.002 |
| 61 | PTLGVVPQA (SEQ ID NO: 2030) | 0.002 |
| 181 | RGQALRRAR (SEQ ID NO: 2031) | 0.001 |
| 141 | GPAFSTLNP (SEQ ID NO: 2032) | 0.001 |
| 158 | EAFPAHPIY (SEQ ID NO: 2033) | 0.001 |
| 167 | DLSQVWSVV (SEQ ID NO: 2034) | 0.001 |
| 120 | GSIDTDPPA (SEQ ID NO: 2035) | 0.001 |
| 152 | RHLFPQEAF (SEQ ID NO: 2036) | 0.001 |
| 133 | NPLCCCFHG (SEQ ID NO: 2037) | 0.001 |
| 169 | SQVWSVVSP (SEQ ID NO: 2038) | 0.001 |
| 14 | RAVTPTCAT (SEQ ID NO: 2039) | 0.001 |

TABLE XIV-continued

V4-HLA-A1101-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 149 | PVLRHLFPQ (SEQ ID NO: 2040) | 0.001 |
| 81 | EPVLVPEAH (SEQ ID NO: 2041) | 0.001 |
| 105 | PDPPMALSR (SEQ ID NO: 2042) | 0.001 |
| 179 | PSRGQALRR (SEQ ID NO: 2043) | 0.001 |
| 164 | PIYDLSQVW (SEQ ID NO: 2044) | 0.001 |
| 95 | TMYVCAPVP (SEQ ID NO: 2045) | 0.001 |
| 153 | HLFPQEAFP (SEQ ID NO: 2046) | 0.001 |
| 56 | GAPLQPTLG (SEQ ID NO: 2047) | 0.001 |
| 83 | VLVPEAHPN (SEQ ID NO: 2048) | 0.001 |
| 59 | LQPTLGVVP (SEQ ID NO: 2049) | 0.001 |
| 166 | YDLSQVWSV (SEQ ID NO: 2050) | 0.001 |
| 72 | PLLTHPAQW (SEQ ID NO: 2051) | 0.001 |
| 130 | GPSNPLCCC (SEQ ID NO: 2052) | 0.001 |
| 37 | RCSLHSACC (SEQ ID NO: 2053) | 0.001 |
| 148 | NPVLRHLFP (SEQ ID NO: 2054) | 0.001 |
| 138 | CFHGPAFST (SEQ ID NO: 2055) | 0.001 |
| 80 | WEPVLVPEA (SEQ ID NO: 2056) | 0.001 |

TABLE XIV-continued

V4-HLA-A1101-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 157 | QEAFPAHPI (SEQ ID NO: 2057) | 0.001 |
| 91 | NASLTMYVC (SEQ ID NO: 2058) | 0.000 |
| 121 | SIDTDPPAD (SEQ ID NO: 2059) | 0.000 |
| 150 | VLRHLFPQE (SEQ ID NO: 2060) | 0.000 |
| 147 | LNPVLRHLF (SEQ ID NO: 2061) | 0.000 |
| 137 | CCFHGPAFS (SEQ ID NO: 2062) | 0.000 |
| 39 | SLHSACCSG (SEQ ID NO: 2063) | 0.000 |
| 118 | QIGSIDTDP (SEQ ID NO: 2064) | 0.000 |
| 46 | SGDPASYRL (SEQ ID NO: 2065) | 0.000 |
| 132 | SNPLCCCFH (SEQ ID NO: 2066) | 0.000 |
| 110 | ALSRTPTRQ (SEQ ID NO: 2067) | 0.000 |
| 93 | SLTMYVCAP (SEQ ID NO: 2068) | 0.000 |
| 159 | AFPAHPIYD (SEQ ID NO: 2069) | 0.000 |
| 58 | PLQPTLGVV (SEQ ID NO: 2070) | 0.000 |
| 62 | TLGVVPQAS (SEQ ID NO: 2071) | 0.000 |
| 146 | TLNPVLRHL (SEQ ID NO: 2072) | 0.000 |
| 73 | LLTHPAQWE (SEQ ID NO: 2073) | 0.000 |

TABLE XIV-continued

V4-HLA-A1101-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 88 | AHPNASLTM (SEQ ID NO: 2074) | 0.000 |
| 165 | IYDLSQVWS (SEQ ID NO: 2075) | 0.000 |
| 49 | PASYRLWGA (SEQ ID NO: 2076) | 0.000 |
| 142 | PAFSTLNPV (SEQ ID NO: 2077) | 0.000 |

TABLE XIV

V19-HLA-A1101-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 5 | CSRLLPSLR (SEQ ID NO: 2078) | 0.004 |
| 8 | LLPSLRCSL (SEQ ID NO: 2079) | 0.004 |
| 9 | LPSLRCSLH (SEQ ID NO: 2080) | 0.002 |
| 1 | GPMPCSRLL (SEQ ID NO: 2081) | 0.001 |
| 3 | MPCSRLLPS (SEQ ID NO: 2082) | 0.000 |
| 4 | PCSRLLPSL (SEQ ID NO: 2083) | 0.000 |
| 7 | RLLPSLRCS (SEQ ID NO: 2084) | 0.000 |
| 2 | PMPCSRLLP (SEQ ID NO: 2085) | 0.000 |
| 6 | SRLLPSLRC (SEQ ID NO: 2086) | 0.000 |

TABLE XIV

V20-HLA-A1101-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 2 | CSGDPASSR (SEQ ID NO: 2087) | 0.004 |
| 6 | PASSRLWGA (SEQ ID NO: 2088) | 0.000 |
| 8 | SSRLWGAPL (SEQ ID NO: 2089) | 0.000 |
| 1 | CCSGDPASS (SEQ ID NO: 2090) | 0.000 |
| 3 | SGDPASSRL (SEQ ID NO: 2091) | 0.000 |
| 5 | DPASSRLWG (SEQ ID NO: 2092) | 0.000 |
| 4 | GDPASSRLW (SEQ ID NO: 2093) | 0.000 |
| 9 | SRLWGAPLQ (SEQ ID NO: 2094) | 0.000 |
| 7 | ASSRLWGAP (SEQ ID NO: 2095) | 0.000 |

TABLE XIV

V21-HLA-A1101-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 3 | SVPLLTDPA (SEQ ID NO: 2096) | 0.020 |
| 7 | LTDPAQWEP (SEQ ID NO: 2097) | 0.002 |
| 5 | PLLTDPAQW (SEQ ID NO: 2098) | 0.001 |
| 9 | DPAQWEPVL (SEQ ID NO: 2099) | 0.001 |
| 6 | LLTDPAQWE (SEQ ID NO: 2100) | 0.000 |

TABLE XIV-continued

V21-HLA-A1101-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 1 | QASVPLLTD (SEQ ID NO: 2101) | 0.000 |
| 4 | VPLLTDPAQ (SEQ ID NO: 2102) | 0.000 |
| 8 | TDPAQWEPV (SEQ ID NO: 2103) | 0.000 |
| 2 | ASVPLLTDP (SEQ ID NO: 2104) | 0.000 |

TABLE XIV

V21&22-HLA-A1101-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 2 | SVPLLTDLA (SEQ ID NO: 2105) | 0.020 |
| 6 | LTDLAQWEP (SEQ ID NO: 2106) | 0.002 |
| 8 | DLAQWEPVL (SEQ ID NO: 2107) | 0.001 |
| 3 | VPLLTDLAQ (SEQ ID NO: 2108) | 0.001 |
| 4 | PLLTDLAQW (SEQ ID NO: 2109) | 0.001 |
| 5 | LLTDLAQWE (SEQ ID NO: 2110) | 0.000 |
| 7 | TDLAQWEPV (SEQ ID NO: 2111) | 0.000 |
| 1 | ASVPLLTDL (SEQ ID NO: 2112) | 0.000 |

TABLE XIV

V22-HLA-A1101-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 2 | SVPLLTHLA (SEQ ID NO: 2113) | 0.020 |
| 8 | HLAQWEPVL (SEQ ID NO: 2114) | 0.004 |
| 9 | LAQWEPVLV (SEQ ID NO: 2115) | 0.002 |
| 6 | LTHLAQWEP (SEQ ID NO: 2116) | 0.002 |
| 3 | VPLLTHLAQ (SEQ ID NO: 2117) | 0.001 |
| 4 | PLLTHLAQW (SEQ ID NO: 2118) | 0.001 |
| 5 | LLTHLAQWE (SEQ ID NO: 2119) | 0.000 |
| 7 | THLAQWEPV (SEQ ID NO: 2120) | 0.000 |
| 1 | ASVPLLTHL (SEQ ID NO: 2121) | 0.000 |

TABLE XIV

V24-HLA-A1101-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 3 | LTMYVCTPV (SEQ ID NO: 2122) | 0.020 |
| 5 | MYVCTPVPH (SEQ ID NO: 2123) | 0.006 |
| 6 | YVCTPVPHP (SEQ ID NO: 2124) | 0.002 |
| 8 | CTPVPHPDP (SEQ ID NO: 2125) | 0.001 |
| 4 | TMYVCTPVP (SEQ ID NO: 2126) | 0.001 |

TABLE XIV-continued

V24-HLA-A1101-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 2 | SLTMYVCTP (SEQ ID NO: 2127) | 0.000 |
| 7 | VCTPVPHPD (SEQ ID NO: 2128) | 0.000 |
| 1 | ASLTMYVCT (SEQ ID NO: 2129) | 0.000 |

TABLE XIV

V25-HLA-A1101-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 2 | RTPTRQISS (SEQ ID NO: 2130) | 0.006 |
| 6 | RQISSIDTD (SEQ ID NO: 2131) | 0.003 |
| 3 | TPTRQISSI (SEQ ID NO: 2132) | 0.002 |
| 7 | QISSIDTDP (SEQ ID NO: 2133) | 0.000 |
| 9 | SSIDTDPPA (SEQ ID NO: 2134) | 0.000 |
| 4 | PTRQISSID (SEQ ID NO: 2135) | 0.000 |
| 5 | TRQISSIDT (SEQ ID NO: 2136) | 0.000 |
| 8 | ISSIDTDPP (SEQ ID NO: 2137) | 0.000 |
| 1 | SRTPTRQIS (SEQ ID NO: 2138) | 0.000 |

TABLE XIV

V25&26-HLA-A1101-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 4 | RQISSSDTD (SEQ ID NO: 2139) | 0.003 |
| 5 | QISSSDTDP (SEQ ID NO: 2140) | 0.000 |
| 7 | SSSDTDPPA (SEQ ID NO: 2141) | 0.000 |
| 1 | TPTRQISSS (SEQ ID NO: 2142) | 0.000 |
| 2 | PTRQISSSD (SEQ ID NO: 2143) | 0.000 |
| 3 | TRQISSSDT (SEQ ID NO: 2144) | 0.000 |
| 6 | ISSSDTDPP (SEQ ID NO: 2145) | 0.000 |

TABLE XIV

V26-HLA-A1101-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 4 | RQIGSSDTD (SEQ ID NO: 2146) | 0.003 |
| 7 | GSSDTDPPA (SEQ ID NO: 2147) | 0.001 |
| 5 | QIGSSDTDP (SEQ ID NO: 2148) | 0.000 |
| 1 | TPTRQIGSS (SEQ ID NO: 2149) | 0.000 |
| 2 | PTRQIGSSD (SEQ ID NO: 2150) | 0.000 |
| 6 | IGSSDTDPP (SEQ ID NO: 2151) | 0.000 |
| 8 | SSDTDPPAD (SEQ ID NO: 2152) | 0.000 |

TABLE XIV-continued

V26-HLA-A1101-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 3 | TRQIGSSDT (SEQ ID NO: 2153) | 0.000 |
| 9 | SDTDPPADG (SEQ ID NO: 2154) | 0.000 |

TABLE XIV

V27-HLA-A1101-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 1 | SRGQALRRA (SEQ ID NO: 2155) | 0.000 |
| 2 | RGQALRRAQ (SEQ ID NO: 2156) | 0.000 |

TABLE XV

V1-HLA-A1101-10MERS-PSCA
Each peptide is a portion of SEQ ID NO: 2;
each start position is specified, the
length of peptide is 10 amino acids, and
the end position for each peptide is the
start position plus nine.

| START | SUBSEQUENCE | SCORE |
|---|---|---|
| 55 | AVGLLTVISK (SEQ ID NO: 2157) | 4.000 |
| 18 | GTALLCYSCK (SEQ ID NO: 2158) | 3.000 |
| 43 | QLGEQCWTAR (SEQ ID NO: 2159) | 0.080 |
| 29 | QVSNEDCLQV (SEQ ID NO: 2160) | 0.040 |
| 70 | CVDDSQDYYV (SEQ ID NO: 2161) | 0.040 |
| 52 | RIRAVGLLTV (SEQ ID NO: 2162) | 0.024 |
| 114 | GLLLWGPGQL (SEQ ID NO: 2163) | 0.018 |

TABLE XV-continued

V1-HLA-A1101-10MERS-PSCA
Each peptide is a portion of SEQ ID NO: 2;
each start position is specified, the
length of peptide is 10 amino acids, and
the end position for each peptide is the
start position plus nine.

| START | SUBSEQUENCE | SCORE |
|---|---|---|
| 2 | KAVLLALLMA (SEQ ID NO: 2164) | 0.018 |
| 42 | TQLGEQCWTA (SEQ ID NO: 2165) | 0.018 |
| 59 | LTVISKGCSL (SEQ ID NO: 2166) | 0.015 |
| 12 | GLALQPGTAL (SEQ ID NO: 2167) | 0.012 |
| 100 | LQPAAAILAL (SEQ ID NO: 2168) | 0.012 |
| 108 | ALLPALGLLL (SEQ ID NO: 2169) | 0.012 |
| 15 | LQPGTALLCY (SEQ ID NO: 2170) | 0.012 |
| 49 | WTARIRAVGL (SEQ ID NO: 2171) | 0.010 |
| 106 | ILALLPALGL (SEQ ID NO: 2172) | 0.008 |
| 99 | ALQPAAAILA (SEQ ID NO: 2173) | 0.008 |
| 109 | LLPALGLLLW (SEQ ID NO: 2174) | 0.008 |
| 27 | KAQVSNEDCL (SEQ ID NO: 2175) | 0.006 |
| 73 | DSQDYYVGKK (SEQ ID NO: 2176) | 0.006 |
| 3 | AVLLALLMAG (SEQ ID NO: 2177) | 0.006 |
| 6 | LALLMAGLAL (SEQ ID NO: 2178) | 0.006 |
| 4 | VLLALLMAGL (SEQ ID NO: 2179) | 0.006 |
| 96 | GAHALQPAAA (SEQ ID NO: 2180) | 0.006 |

TABLE XV-continued

V1-HLA-A1101-10MERS-PSCA
Each peptide is a portion of SEQ ID NO: 2;
each start position is specified, the
length of peptide is 10 amino acids, and
the end position for each peptide is the
start position plus nine.

| START | SUBSEQUENCE | SCORE |
|---|---|---|
| 72 | DDSQDYYVGK (SEQ ID NO: 2181) | 0.006 |
| 21 | LLCYSCKAQV (SEQ ID NO: 2182) | 0.004 |
| 103 | AAAILALLPA (SEQ ID NO: 2183) | 0.004 |
| 37 | QVENCTQLGE (SEQ ID NO: 2184) | 0.004 |
| 35 | CLQVENCTQL (SEQ ID NO: 2185) | 0.004 |
| 5 | LLALLMAGLA (SEQ ID NO: 2186) | 0.004 |
| 46 | EQCWTARIRA (SEQ ID NO: 2187) | 0.004 |
| 45 | GEQCWTARIR (SEQ ID NO: 2188) | 0.004 |
| 19 | TALLCYSCKA (SEQ ID NO: 2189) | 0.003 |
| 107 | LALLPALGLL (SEQ ID NO: 2190) | 0.003 |
| 69 | NCVDDSQDYY (SEQ ID NO: 2191) | 0.003 |
| 60 | TVISKGCSLN (SEQ ID NO: 2192) | 0.003 |
| 104 | AAILALLPAL (SEQ ID NO: 2193) | 0.003 |
| 13 | LALQPGTALL (SEQ ID NO: 2194) | 0.003 |
| 98 | HALQPAAAIL (SEQ ID NO: 2195) | 0.003 |
| 88 | DTDLCNASGA (SEQ ID NO: 2196) | 0.003 |
| 84 | ITCCDTDLCN (SEQ ID NO: 2197) | 0.002 |
| 91 | LCNASGAHAL (SEQ ID NO: 2198) | 0.002 |
| 85 | TCCDTDLCNA (SEQ ID NO: 2199) | 0.002 |
| 50 | TARIRAVGLL (SEQ ID NO: 2200) | 0.002 |
| 78 | YVGKKNITCC (SEQ ID NO: 2201) | 0.002 |
| 101 | QPAAAILALL (SEQ ID NO: 2202) | 0.002 |
| 40 | NCTQLGEQCW (SEQ ID NO: 2203) | 0.002 |
| 82 | KNITCCDTDL (SEQ ID NO: 2204) | 0.002 |
| 8 | LLMAGLALQP (SEQ ID NO: 2205) | 0.002 |
| 77 | YYVGKKNITC (SEQ ID NO: 2206) | 0.001 |
| 90 | DLCNASGAHA (SEQ ID NO: 2207) | 0.001 |
| 41 | CTQLGEQCWT (SEQ ID NO: 2208) | 0.001 |
| 28 | AQVSNEDCLQ (SEQ ID NO: 2209) | 0.001 |
| 54 | RAVGLLTVIS (SEQ ID NO: 2210) | 0.001 |
| 36 | LQVENCTQLG (SEQ ID NO: 2211) | 0.001 |
| 57 | GLLTVISKGC (SEQ ID NO: 2212) | 0.001 |
| 14 | ALQPGTALLC (SEQ ID NO: 2213) | 0.001 |
| 61 | VISKGCSLNC (SEQ ID NO: 2214) | 0.001 |

TABLE XV-continued

V1-HLA-A1101-10MERS-PSCA
Each peptide is a portion of SEQ ID NO: 2;
each start position is specified, the
length of peptide is 10 amino acids, and
the end position for each peptide is the
start position plus nine.

| START | SUBSEQUENCE | SCORE |
|---|---|---|
| 65 | GCSLNCVDDS (SEQ ID NO: 2215) | 0.001 |
| 105 | AILALLPALG (SEQ ID NO: 2216) | 0.001 |
| 7 | ALLMAGLALQ (SEQ ID NO: 2217) | 0.001 |
| 83 | NITCCDTDLC (SEQ ID NO: 2218) | 0.000 |
| 47 | QCWTARIRAV (SEQ ID NO: 2219) | 0.000 |
| 68 | LNCVDDSQDY (SEQ ID NO: 2220) | 0.000 |
| 1 | MKAVLLALLM (SEQ ID NO: 2221) | 0.000 |
| 110 | LPALGLLLWG (SEQ ID NO: 2222) | 0.000 |
| 9 | LMAGLLALQPG (SEQ ID NO: 2223) | 0.000 |
| 22 | LCYSCKAQVS (SEQ ID NO: 2224) | 0.000 |
| 23 | CYSCKAQVSN (SEQ ID NO: 2225) | 0.000 |
| 67 | SLNCVDDSQD (SEQ ID NO: 2226) | 0.000 |
| 112 | ALGLLLWGPG (SEQ ID NO: 2227) | 0.000 |
| 58 | LLTVISKGCS (SEQ ID NO: 2228) | 0.000 |
| 93 | NASGAHALQP (SEQ ID NO: 2229) | 0.000 |
| 20 | ALLCYSCKAQ (SEQ ID NO: 2230) | 0.000 |
| 74 | SQDYYVGKKN (SEQ ID NO: 2231) | 0.000 |
| 11 | AGLALQPGTA (SEQ ID NO: 2232) | 0.000 |
| 89 | TDLCNASGAH (SEQ ID NO: 2233) | 0.000 |
| 76 | DYYVGKKNIT (SEQ ID NO: 2234) | 0.000 |
| 16 | QPGTALLCYS (SEQ ID NO: 2235) | 0.000 |
| 10 | MAGLALQPGT (SEQ ID NO: 2236) | 0.000 |
| 86 | CCDTDLCNAS (SEQ ID NO: 2237) | 0.000 |
| 75 | QDYYVGKKNI (SEQ ID NO: 2238) | 0.000 |
| 94 | ASGAHALQPA (SEQ ID NO: 2239) | 0.000 |
| 53 | IRAVGLLTVI (SEQ ID NO: 2240) | 0.000 |
| 95 | SGAHALQPAA (SEQ ID NO: 2241) | 0.000 |
| 62 | ISKGCSLNCV (SEQ ID NO: 2242) | 0.000 |
| 97 | AHALQPAAAI (SEQ ID NO: 2243) | 0.000 |
| 44 | LGEQCWTARI (SEQ ID NO: 2244) | 0.000 |
| 25 | SCKAQVSNED (SEQ ID NO: 2245) | 0.000 |
| 34 | DCLQVENCTQ (SEQ ID NO: 2246) | 0.000 |
| 51 | ARIRAVGLLT (SEQ ID NO: 2247) | 0.000 |
| 111 | PALGLLLWGP (SEQ ID NO: 2248) | 0.000 |

TABLE XV-continued

V1-HLA-A1101-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 81 | KKNITCCDTD (SEQ ID NO: 2249) | 0.000 |
| 64 | KGCSLNCVDD (SEQ ID NO: 2250) | 0.000 |
| 80 | GKKNITCCDT (SEQ ID NO: 2251) | 0.000 |
| 32 | NEDCLQVENC (SEQ ID NO: 2252) | 0.000 |
| 38 | VENCTQLGEQ (SEQ ID NO: 2253) | 0.000 |
| 92 | CNASGAHALQ (SEQ ID NO: 2254) | 0.000 |
| 102 | PAAAILALLP (SEQ ID NO: 2255) | 0.000 |
| 31 | SNEDCLQVEN (SEQ ID NO: 2256) | 0.000 |

TABLE XV

V4-HLA-A1101-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 1 | MTHRTTTWAR (SEQ ID NO: 2257) | 0.400 |
| 5 | TTTWARRTSR (SEQ ID NO: 2258) | 0.200 |
| 64 | GVVPQASVPL (SEQ ID NO: 2259) | 0.090 |
| 178 | APSRGQALRR (SEQ ID NO: 2260) | 0.080 |
| 104 | HPDPPMALSR (SEQ ID NO: 2261) | 0.080 |
| 143 | AFSTLNPVLR (SEQ ID NO: 2262) | 0.040 |

TABLE XV-continued

V4-HLA-A1101-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 44 | CCSGDPASYR (SEQ ID NO: 2263) | 0.040 |
| 22 | TPAGPMPCSR (SEQ ID NO: 2264) | 0.040 |
| 113 | RTPTRQIGSI (SEQ ID NO: 2265) | 0.030 |
| 153 | HLFPQEAFPA (SEQ ID NO: 2266) | 0.024 |
| 15 | AVTPTCATPA (SEQ ID NO: 2267) | 0.020 |
| 6 | TTWARRTSRA (SEQ ID NO: 2268) | 0.020 |
| 65 | VVPQASVPLL (SEQ ID NO: 2269) | 0.020 |
| 31 | RLPPSLRCSL (SEQ ID NO: 2270) | 0.012 |
| 56 | GAPLQPTLGV (SEQ ID NO: 2271) | 0.012 |
| 74 | LTHPAQWEPV (SEQ ID NO: 2272) | 0.010 |
| 169 | SQVWSVVSPA (SEQ ID NO: 2273) | 0.009 |
| 95 | TMYVCAPVPH (SEQ ID NO: 2274) | 0.008 |
| 108 | PMALSRTPTR (SEQ ID NO: 2275) | 0.008 |
| 165 | IYDLSQVWSV (SEQ ID NO: 2276) | 0.008 |
| 172 | WSVVSPAPSR (SEQ ID NO: 2277) | 0.006 |
| 83 | VLVPEAHPNA (SEQ ID NO: 2278) | 0.006 |
| 130 | GPSNPLCCCF (SEQ ID NO: 2279) | 0.006 |

TABLE XV-continued

V4-HLA-A1101-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 141 | GPAFSTLNPV (SEQ ID NO: 2280) | 0.006 |
| 62 | TLGVVPQASV (SEQ ID NO: 2281) | 0.004 |
| 146 | TLNPVLRHLF (SEQ ID NO: 2282) | 0.004 |
| 170 | QVWSVVSPAP (SEQ ID NO: 2283) | 0.004 |
| 102 | VPHPDPPMAL (SEQ ID NO: 2284) | 0.004 |
| 177 | PAPSRGQALR (SEQ ID NO: 2285) | 0.004 |
| 150 | VLRHLFPQEA (SEQ ID NO: 2286) | 0.004 |
| 28 | PCSRLPPSLR (SEQ ID NO: 2287) | 0.004 |
| 89 | HPNASLTMYV (SEQ ID NO: 2288) | 0.004 |
| 93 | SLTMYVCAPV (SEQ ID NO: 2289) | 0.004 |
| 159 | AFPAHPIYDL (SEQ ID NO: 2290) | 0.004 |
| 2 | THRTTTWARR (SEQ ID NO: 2291) | 0.004 |
| 163 | HPIYDLSQVW (SEQ ID NO: 2292) | 0.003 |
| 100 | APVPHPDPPM (SEQ ID NO: 2293) | 0.003 |
| 173 | SVVSPAPSRG (SEQ ID NO: 2294) | 0.003 |
| 57 | APLQPTLGVV (SEQ ID NO: 2295) | 0.003 |
| 11 | RTSRAVTPTC (SEQ ID NO: 2296) | 0.003 |
| 71 | VPLLTHPAQW (SEQ ID NO: 2297) | 0.003 |
| 117 | RQIGSIDTDP (SEQ ID NO: 2298) | 0.003 |
| 25 | GPMPCSRLPP (SEQ ID NO: 2299) | 0.002 |
| 53 | RLWGAPLQPT (SEQ ID NO: 2300) | 0.002 |
| 70 | SVPLLTHPAQ (SEQ ID NO: 2301) | 0.002 |
| 43 | ACCSGDPASY (SEQ ID NO: 2302) | 0.002 |
| 91 | NASLTMYVCA (SEQ ID NO: 2303) | 0.002 |
| 94 | LTMYVCAPVP (SEQ ID NO: 2304) | 0.002 |
| 97 | YVCAPVPHPD (SEQ ID NO: 2305) | 0.002 |
| 84 | LVPEAHPNAS (SEQ ID NO: 2306) | 0.002 |
| 76 | HPAQWEPVLV (SEQ ID NO: 2307) | 0.002 |
| 32 | LPPSLRCSLH (SEQ ID NO: 2308) | 0.002 |
| 60 | QPTLGVVPQA (SEQ ID NO: 2309) | 0.002 |
| 85 | VPEAHPNASL (SEQ ID NO: 2310) | 0.002 |
| 27 | MPCSRLPPSL (SEQ ID NO: 2311) | 0.002 |
| 101 | PVPHPDPPMA (SEQ ID NO: 2312) | 0.002 |
| 154 | LFPQEAFPAH (SEQ ID NO: 2313) | 0.002 |

TABLE XV-continued

V4-HLA-A1101-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 176 | SPAPSRGQAL (SEQ ID NO: 2314) | 0.002 |
| 138 | CFHGPAFSTL (SEQ ID NO: 2315) | 0.002 |
| 135 | LCCCFHGPAF (SEQ ID NO: 2316) | 0.002 |
| 145 | STLNPVLRHL (SEQ ID NO: 2317) | 0.002 |
| 137 | CCFHGPAFST (SEQ ID NO: 2318) | 0.001 |
| 67 | PQASVPLLTH (SEQ ID NO: 2319) | 0.001 |
| 78 | AQWEPVLVPE (SEQ ID NO: 2320) | 0.001 |
| 87 | EAHPNASLTM (SEQ ID NO: 2321) | 0.001 |
| 48 | DPASYRLWGA (SEQ ID NO: 2322) | 0.001 |
| 21 | ATPAGPMPCS (SEQ ID NO: 2323) | 0.001 |
| 16 | VTPTCATPAG (SEQ ID NO: 2324) | 0.001 |
| 18 | PTCATPAGPM (SEQ ID NO: 2325) | 0.001 |
| 148 | NPVLRHLFPQ (SEQ ID NO: 2326) | 0.001 |
| 14 | RAVTPTCATP (SEQ ID NO: 2327) | 0.001 |
| 73 | LLTHPAQWEP (SEQ ID NO: 2328) | 0.001 |
| 96 | MYVCAPVPHP (SEQ ID NO: 2329) | 0.001 |
| 59 | LQPTLGVVPQ (SEQ ID NO: 2330) | 0.001 |

TABLE XV-continued

V4-HLA-A1101-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 37 | RCSLHSACCS (SEQ ID NO: 2331) | 0.001 |
| 156 | PQEAFPAHPI (SEQ ID NO: 2332) | 0.001 |
| 80 | WEPVLVPEAH (SEQ ID NO: 2333) | 0.001 |
| 157 | QEAFPAHPIY (SEQ ID NO: 2334) | 0.001 |
| 180 | SRGQALRRAR (SEQ ID NO: 2335) | 0.000 |
| 121 | SIDTDPPADG (SEQ ID NO: 2336) | 0.000 |
| 134 | PLCCCFHGPA (SEQ ID NO: 2337) | 0.000 |
| 66 | VPQASVPLLT (SEQ ID NO: 2338) | 0.000 |
| 144 | FSTLNPVLRH (SEQ ID NO: 2339) | 0.000 |
| 20 | CATPAGPMPC (SEQ ID NO: 2340) | 0.000 |
| 118 | QIGSIDTDPP (SEQ ID NO: 2341) | 0.000 |
| 142 | PAFSTLNPVL (SEQ ID NO: 2342) | 0.000 |
| 35 | SLRCSLHSAC (SEQ ID NO: 2343) | 0.000 |
| 51 | SYRLWGAPLQ (SEQ ID NO: 2344) | 0.000 |
| 50 | ASYRLWGAPL (SEQ ID NO: 2345) | 0.000 |
| 39 | SLHSACCSGD (SEQ ID NO: 2346) | 0.000 |
| 110 | ALSRTPTRQI (SEQ ID NO: 2347) | 0.000 |

TABLE XV-continued

V4-HLA-A1101-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 45 | CSGDPASYRL (SEQ ID NO: 2348) | 0.000 |
| 69 | ASVPLLTHPA (SEQ ID NO: 2349) | 0.000 |
| 4 | RTTTWARRTS (SEQ ID NO: 2350) | 0.000 |
| 123 | DTDPPADGPS (SEQ ID NO: 2351) | 0.000 |
| 166 | YDLSQVWSVV (SEQ ID NO: 2352) | 0.000 |
| 82 | PVLVPEAHPN (SEQ ID NO: 2353) | 0.000 |
| 133 | NPLCCCFHGP (SEQ ID NO: 2354) | 0.000 |
| 149 | PVLRHLFPQE (SEQ ID NO: 2355) | 0.000 |
| 109 | MALSRTPTRQ (SEQ ID NO: 2356) | 0.000 |

TABLE XV

V19-HLA-A1101-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 8 | RLLPSLRCSL (SEQ ID NO: 2357) | 0.018 |
| 9 | LLPSLRCSLH (SEQ ID NO: 2358) | 0.004 |
| 5 | PCSRLLPSLR (SEQ ID NO: 2359) | 0.004 |
| 2 | GPMPCSRLLP (SEQ ID NO: 2360) | 0.002 |
| 4 | MPCSRLLPSL (SEQ ID NO: 2361) | 0.002 |
| 10 | LPSLRCSLHS (SEQ ID NO: 2362) | 0.000 |
| 3 | PMPCSRLLPS (SEQ ID NO: 2363) | 0.000 |
| 6 | CSRLLPSLRC (SEQ ID NO: 2364) | 0.000 |
| 1 | AGPMPCSRLL (SEQ ID NO: 2365) | 0.000 |
| 7 | SRLLPSLRCS (SEQ ID NO: 2366) | 0.000 |

TABLE XV

V20-HLA-A1101-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 2 | CCSGDPASSR (SEQ ID NO: 2367) | 0.040 |
| 6 | DPASSRLWGA (SEQ ID NO: 2368) | 0.001 |
| 8 | ASSRLWGAPL (SEQ ID NO: 2369) | 0.000 |
| 1 | ACCSGDPASS (SEQ ID NO: 2370) | 0.000 |
| 3 | CSGDPASSRL (SEQ ID NO: 2371) | 0.000 |
| 5 | GDPASSRLWG (SEQ ID NO: 2372) | 0.000 |
| 10 | SRLWGAPLQP (SEQ ID NO: 2373) | 0.000 |
| 4 | SGDPASSRLW (SEQ ID NO: 2374) | 0.000 |
| 7 | PASSRLWGAP (SEQ ID NO: 2375) | 0.000 |

TABLE XV-continued

V20-HLA-A1101-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 9 | SSRLWGAPLQ (SEQ ID NO: 2376) | 0.000 |

TABLE XV

V21-HLA-A1101-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 8 | LTDPAQWEPV (SEQ ID NO: 2377) | 0.010 |
| 5 | VPLLTDPAQW (SEQ ID NO: 2378) | 0.003 |
| 4 | SVPLLTDPAQ (SEQ ID NO: 2379) | 0.002 |
| 7 | LLTDPAQWEP (SEQ ID NO: 2380) | 0.001 |
| 10 | DPAQWEPVLV (SEQ ID NO: 2381) | 0.001 |
| 3 | ASVPLLTDPA (SEQ ID NO: 2382) | 0.000 |
| 9 | TDPAQWEPVL (SEQ ID NO: 2383) | 0.000 |
| 2 | QASVPLLTDP (SEQ ID NO: 2384) | 0.000 |
| 1 | PQASVPLLTD (SEQ ID NO: 2385) | 0.000 |
| 6 | PLLTDPAQWE (SEQ ID NO: 2386) | 0.000 |

TABLE XV

V21&V22-HLA-A1101-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 7 | LTDPAQWEPV (SEQ ID NO: 2387) | 0.010 |
| 3 | SVPLLTDLAQ (SEQ ID NO: 2388) | 0.004 |
| 4 | VPLLTDLAQW (SEQ ID NO: 2389) | 0.003 |
| 1 | QASVPLLTDL (SEQ ID NO: 2390) | 0.002 |
| 9 | DLAQWEPVLV (SEQ ID NO: 2391) | 0.001 |
| 6 | LLTDLAQWEP (SEQ ID NO: 2392) | 0.001 |
| 8 | TDLAQWEPVL (SEQ ID NO: 2393) | 0.000 |
| 2 | ASVPLLTDLA (SEQ ID NO: 2394) | 0.000 |
| 5 | PLLTDLAQWE (SEQ ID NO: 2395) | 0.000 |

TABLE XV

V22-HLA-A1101-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 7 | LTHLAQWEPV (SEQ ID NO: 2396) | 0.010 |
| 9 | HLAQWEPVLV (SEQ ID NO: 2397) | 0.004 |
| 3 | SVPLLTHLAQ (SEQ ID NO: 2398) | 0.004 |
| 4 | VPLLTHLAQW (SEQ ID NO: 2399) | 0.003 |
| 1 | QASVPLLTHL (SEQ ID NO: 2400) | 0.002 |

TABLE XV-continued

V22-HLA-A1101-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 6 | LLTHLAQWEP (SEQ ID NO: 2401) | 0.001 |
| 10 | LAQWEPVLVP (SEQ ID NO: 2402) | 0.000 |
| 8 | THLAQWEPVL (SEQ ID NO: 2403) | 0.000 |
| 2 | ASVPLLTHLA (SEQ ID NO: 2404) | 0.000 |
| 5 | PLLTHLAQWE (SEQ ID NO: 2405) | 0.000 |

TABLE XV

V24-HLA-A1101-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 5 | TMYVCTPVPH (SEQ ID NO: 2406) | 0.008 |
| 3 | SLTMYVCTPV (SEQ ID NO: 2407) | 0.004 |
| 10 | TPVPHPDPPM (SEQ ID NO: 2408) | 0.003 |
| 4 | LTMYVCTPVP (SEQ ID NO: 2409) | 0.002 |
| 7 | YVCTPVPHPD (SEQ ID NO: 2410) | 0.002 |
| 9 | CTPVPHPDPP (SEQ ID NO: 2411) | 0.001 |
| 6 | MYVCTPVPHP (SEQ ID NO: 2412) | 0.001 |
| 8 | VCTPVPHPDP (SEQ ID NO: 2413) | 0.000 |
| 1 | NASLTMYVCT (SEQ ID NO: 2414) | 0.000 |

TABLE XV-continued

V24-HLA-A1101-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 2 | ASLTMYVCTP (SEQ ID NO: 2415) | 0.000 |

TABLE XV

V25-HLA-A1101-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 3 | RTPTRQISSI (SEQ ID NO: 2416) | 0.030 |
| 7 | RQISSIDTDP (SEQ ID NO: 2417) | 0.003 |
| 8 | QISSIDTDPP (SEQ ID NO: 2418) | 0.000 |
| 9 | ISSIDTDPPA (SEQ ID NO: 2419) | 0.000 |
| 5 | PTRQISSIDT (SEQ ID NO: 2420) | 0.000 |
| 4 | TPTRQISSID (SEQ ID NO: 2421) | 0.000 |
| 2 | SRTPTRQISS (SEQ ID NO: 2422) | 0.000 |
| 10 | SSIDTDPPAD (SEQ ID NO: 2423) | 0.000 |
| 6 | TRQISSIDTD (SEQ ID NO: 2424) | 0.000 |
| 1 | LSRTPTRQIS (SEQ ID NO: 2425) | 0.000 |

TABLE XV

V25&26-HLA-A1101-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 1 | RTPTRQISSS (SEQ ID NO: 2426) | 0.030 |
| 5 | RQISSSDTDP (SEQ ID NO: 2427) | 0.003 |
| 6 | QISSSDTDPP (SEQ ID NO: 2428) | 0.000 |
| 7 | ISSSDTDPPA (SEQ ID NO: 2429) | 0.000 |
| 2 | TPTRQISSSD (SEQ ID NO: 2430) | 0.000 |
| 3 | PTRQISSSDT (SEQ ID NO: 2431) | 0.000 |
| 4 | TRQISSSDTD (SEQ ID NO: 2432) | 0.000 |
| 8 | SSSDTDPPAD (SEQ ID NO: 2433) | 0.000 |

TABLE XV

V26-HLA-A1101-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 1 | RTPTRQISSS (SEQ ID NO: 2434) | 0.003 |
| 5 | RQISSSDTDP (SEQ ID NO: 2435) | 0.003 |
| 6 | QISSSDTDPP (SEQ ID NO: 2436) | 0.000 |
| 7 | ISSSDTDPPA (SEQ ID NO: 2437) | 0.000 |
| 2 | TPTRQISSSD (SEQ ID NO: 2438) | 0.000 |
| 3 | PTRQISSSDT (SEQ ID NO: 2439) | 0.000 |
| 4 | TRQISSSDTD (SEQ ID NO: 2440) | 0.000 |
| 8 | SSSDTDPPAD (SEQ ID NO: 2441) | 0.000 |

TABLE XV

V27-HLA-A1101-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 2 | SRGQALRRAQ (SEQ ID NO: 2442) | 0.000 |
| 1 | PSRGQALRRA (SEQ ID NO: 2443) | 0.000 |

TABLE XVI

V1-HLA-A24-9MERS-PSCA
Each peptide is a portion of SEQ
ID NO: 2; each start position is
specified, the length of peptide is 9
amino acids, and the end position
for each peptide is the start
position plus eight.

| START | SUBSEQUENCE | SCORE |
|---|---|---|
| 76 | DYYVGKKNI (SEQ ID NO: 2444) | 50.000 |
| 77 | YYVGKKNIT (SEQ ID NO: 2445) | 9.000 |
| 36 | LQVENCTQL (SEQ ID NO: 2446) | 7.200 |
| 108 | ALLPALGLL (SEQ ID NO: 2447) | 7.200 |
| 99 | ALQPAAAIL (SEQ ID NO: 2448) | 7.200 |
| 109 | LLPALGLLL (SEQ ID NO: 2449) | 7.200 |

TABLE XVI-continued

V1-HLA-A24-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 14 | ALQPGTALL (SEQ ID NO: 2450) | 7.200 |
| 105 | AILALLPAL (SEQ ID NO: 2451) | 7.200 |
| 60 | TVISKGCSL (SEQ ID NO: 2452) | 6.000 |
| 23 | CYSCKAQVS (SEQ ID NO: 2453) | 6.000 |
| 7 | ALLMAGLAL (SEQ ID NO: 2454) | 6.000 |
| 115 | LLLWGPGQL (SEQ ID NO: 2455) | 6.000 |
| 28 | AQVSNEDCL (SEQ ID NO: 2456) | 6.000 |
| 13 | LALQPGTAL (SEQ ID NO: 2457) | 6.000 |
| 107 | LALLPALGL (SEQ ID NO: 2458) | 6.000 |
| 5 | LLALLMAGL (SEQ ID NO: 2459) | 4.800 |
| 101 | QPAAAILAL (SEQ ID NO: 2460) | 4.000 |
| 83 | NITCCDTDL (SEQ ID NO: 2461) | 4.000 |
| 50 | TARIRAVGL (SEQ ID NO: 2462) | 4.000 |
| 92 | CNASGAHAL (SEQ ID NO: 2463) | 4.000 |
| 54 | RAVGLLTVI (SEQ ID NO: 2464) | 3.600 |
| 2 | KAVLLALLM (SEQ ID NO: 2465) | 1.800 |
| 98 | HALQPAAAI (SEQ ID NO: 2466) | 1.500 |

TABLE XVI-continued

V1-HLA-A24-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 51 | ARIRAVGLL (SEQ ID NO: 2467) | 0.600 |
| 102 | PAAAILALL (SEQ ID NO: 2468) | 0.560 |
| 1 | MKAVLLALL (SEQ ID NO: 2469) | 0.480 |
| 27 | KAQVSNEDC (SEQ ID NO: 2470) | 0.300 |
| 52 | RIRAVGLLT (SEQ ID NO: 2471) | 0.280 |
| 34 | DCLQVENCT (SEQ ID NO: 2472) | 0.252 |
| 69 | NCVDDSQDY (SEQ ID NO: 2473) | 0.216 |
| 41 | CTQLGEQCW (SEQ ID NO: 2474) | 0.180 |
| 30 | VSNEDCLQV (SEQ ID NO: 2475) | 0.180 |
| 11 | AGLALQPGT (SEQ ID NO: 2476) | 0.180 |
| 20 | ALLCYSCKA (SEQ ID NO: 2477) | 0.165 |
| 45 | GEQCWTARI (SEQ ID NO: 2478) | 0.150 |
| 6 | LALLMAGLA (SEQ ID NO: 2479) | 0.150 |
| 42 | TQLGEQCWT (SEQ ID NO: 2480) | 0.150 |
| 3 | AVLLALLMA (SEQ ID NO: 2481) | 0.150 |
| 59 | LTVISKGCS (SEQ ID NO: 2482) | 0.150 |
| 100 | LQPAAAILA (SEQ ID NO: 2483) | 0.150 |

TABLE XVI-continued

V1-HLA-A24-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 15 | LQPGTALLC (SEQ ID NO: 2484) | 0.150 |
| 66 | CSLNCVDDS (SEQ ID NO: 2485) | 0.150 |
| 104 | TQLGEQCWT (SEQ ID NO: 2486) | 0.150 |
| 91 | LCNASGAHA (SEQ ID NO: 2487) | 0.150 |
| 58 | LLTVISKGC (SEQ ID NO: 2488) | 0.140 |
| 55 | AVGLLTVIS (SEQ ID NO: 2489) | 0.120 |
| 85 | TCCDTDLCN (SEQ ID NO: 2490) | 0.120 |
| 43 | QLGEQCWTA (SEQ ID NO: 2491) | 0.120 |
| 18 | GTASSCYSC (SEQ ID NO: 2492) | 0.120 |
| 40 | NCTQLGEQC (SEQ ID NO: 2493) | 0.120 |
| 96 | GAHALQPAA (SEQ ID NO: 2494) | 0.120 |
| 70 | CVDDSQDYY (SEQ ID NO: 2495) | 0.120 |
| 95 | SGAHALQPA (SEQ ID NO: 2496) | 0.120 |
| 22 | LCYSCKAQV (SEQ ID NO: 2497) | 0.100 |
| 61 | VISKGCSLN (SEQ ID NO: 2498) | 0.100 |
| 47 | QCWTARIRA (SEQ ID NO: 2499) | 0.100 |
| 16 | QPGTALLCY (SEQ ID NO: 2500) | 0.100 |

TABLE XVI-continued

V1-HLA-A24-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 78 | YVGKKNITC (SEQ ID NO: 2501) | 0.100 |
| 84 | ITCCDTDLC (SEQ ID NO: 2502) | 0.100 |
| 86 | CCDTDLCNA (SEQ ID NO: 2503) | 0.100 |
| 24 | YSCKAQVSN (SEQ ID NO: 2504) | 0.100 |
| 48 | CWTARIRAV (SEQ ID NO: 2505) | 0.100 |
| 110 | LPALGLLLW (SEQ ID NO: 2506) | 0.100 |
| 62 | ISKGCSLNC (SEQ ID NO: 2507) | 0.100 |
| 79 | VGKKNITCC (SEQ ID NO: 2508) | 0.100 |
| 12 | GLALQPGTA (SEQ ID NO: 2509) | 0.100 |
| 82 | KNITCCDTD (SEQ ID NO: 2510) | 0.030 |
| 81 | KKNITCCDT (SEQ ID NO: 2511) | 0.030 |
| 64 | KGCSLNCVD (SEQ ID NO: 2512) | 0.024 |
| 57 | GLLTVISKG (SEQ ID NO: 2513) | 0.023 |
| 31 | SNEDCLQVE (SEQ ID NO: 2514) | 0.022 |
| 67 | SLNCVDDSQ (SEQ ID NO: 2515) | 0.021 |
| 113 | LGLLLWGPG (SEQ ID NO: 2516) | 0.018 |
| 37 | QVENCTQLG (SEQ ID NO: 2517) | 0.018 |

TABLE XVI-continued

V1-HLA-A24-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 4 | VLLALLMAG (SEQ ID NO: 2518) | 0.018 |
| 73 | DSQDYYVGK (SEQ ID NO: 2519) | 0.018 |
| 87 | CDTDLCNAS (SEQ ID NO: 2520) | 0.017 |
| 75 | QDYYVGKKN (SEQ ID NO: 2521) | 0.015 |
| 44 | LGEQCWTAR (SEQ ID NO: 2522) | 0.015 |
| 19 | TALLCYSCK (SEQ ID NO: 2523) | 0.015 |
| 114 | GLLLWGPGQ (SEQ ID NO: 2524) | 0.015 |
| 89 | TDLCNASGA (SEQ ID NO: 2525) | 0.015 |
| 8 | LLMAGLALQ (SEQ ID NO: 2526) | 0.015 |
| 56 | VGLLTVISK (SEQ ID NO: 2527) | 0.015 |
| 35 | CLQVENCTQ (SEQ ID NO: 2528) | 0.015 |
| 49 | WTARIRAVG (SEQ ID NO: 2529) | 0.014 |
| 32 | NEDCLQVEN (SEQ ID NO: 2530) | 0.013 |
| 103 | AAAILALLP (SEQ ID NO: 2531) | 0.012 |
| 112 | ALGLLLWGP (SEQ ID NO: 2532) | 0.012 |
| 63 | SKGCSLNCV (SEQ ID NO: 2533) | 0.012 |
| 9 | LMAGLALQP (SEQ ID NO: 2534) | 0.012 |

TABLE XVI-continued

V1-HLA-A24-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 10 | MAGLALQPG (SEQ ID NO: 2535) | 0.012 |
| 17 | PGTALLCYS (SEQ ID NO: 2536) | 0.012 |
| 106 | ILALLPALG (SEQ ID NO: 2537) | 0.012 |
| 74 | SQDYYVGKK (SEQ ID NO: 2538) | 0.011 |
| 39 | ENCTQLGEQ (SEQ ID NO: 2539) | 0.011 |
| 29 | QVSNEDCLQ (SEQ ID NO: 2540) | 0.010 |
| 21 | LLCYSCKAQ (SEQ ID NO: 2541) | 0.010 |
| 97 | AHALQPAAA (SEQ ID NO: 2542) | 0.010 |
| 25 | SCKAQVSNE (SEQ ID NO: 2543) | 0.010 |

TABLE XVI

V4-HLA-A24-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 51 | SYRLWGAPL (SEQ ID NO: 2544) | 200.000 |
| 143 | AFSTLNPVL (SEQ ID NO: 2545) | 24.000 |
| 146 | TLNPVLRHL (SEQ ID NO: 2546) | 10.080 |
| 32 | LPPSLRCSL (SEQ ID NO: 2547) | 7.200 |
| 65 | VVPQASVPL (SEQ ID NO: 2548) | 6.000 |

TABLE XVI-continued

V4-HLA-A24-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 66 | VPQASVPLL (SEQ ID NO: 2549) | 6.000 |
| 24 | AGPMPCSRL (SEQ ID NO: 2550) | 6.000 |
| 55 | WGAPLQPTL (SEQ ID NO: 2551) | 5.760 |
| 165 | IYDLSQVWS (SEQ ID NO: 2552) | 5.000 |
| 46 | SGDPASYRL (SEQ ID NO: 2553) | 4.800 |
| 160 | FPAHPIYDL (SEQ ID NO: 2554) | 4.000 |
| 76 | HPAQWEPVL (SEQ ID NO: 2555) | 4.000 |
| 147 | LNPVLRHLF (SEQ ID NO: 2556) | 3.600 |
| 136 | CCCFHGPAF (SEQ ID NO: 2557) | 2.000 |
| 114 | TPTRQIGSI (SEQ ID NO: 2558) | 1.000 |
| 111 | LSRTPTRQI (SEQ ID NO: 2559) | 1.000 |
| 154 | LFPQEAFPA (SEQ ID NO: 2560) | 0.750 |
| 96 | MYVCAPVPH (SEQ ID NO: 2561) | 0.750 |
| 177 | PAPSRGQAL (SEQ ID NO: 2562) | 0.720 |
| 152 | RHLFPQEAF (SEQ ID NO: 2563) | 0.600 |
| 139 | FHGPAFSTL (SEQ ID NO: 2564) | 0.576 |
| 138 | CFHGPAFST (SEQ ID NO: 2565) | 0.500 |

TABLE XVI-continued

V4-HLA-A24-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 19 | TCATPAGPM (SEQ ID NO: 2566) | 0.500 |
| 28 | PCSRLPPSL (SEQ ID NO: 2567) | 0.480 |
| 127 | PADGPSNPL (SEQ ID NO: 2568) | 0.480 |
| 131 | PSNPLCCCF (SEQ ID NO: 2569) | 0.432 |
| 31 | RLPPSLRCS (SEQ ID NO: 2570) | 0.360 |
| 113 | RTPTRQIGS (SEQ ID NO: 2571) | 0.300 |
| 14 | RAVTPTCAT (SEQ ID NO: 2572) | 0.300 |
| 94 | LTMYVCAPV (SEQ ID NO: 2573) | 0.210 |
| 11 | RTSRAVTPT (SEQ ID NO: 2574) | 0.200 |
| 4 | RTTTWARRT (SEQ ID NO: 2575) | 0.200 |
| 37 | RCSLHSACC (SEQ ID NO: 2576) | 0.200 |
| 84 | LVPEAHPNA (SEQ ID NO: 2577) | 0.180 |
| 83 | VLVPEAHPN (SEQ ID NO: 2578) | 0.180 |
| 85 | VPEAHPNAS (SEQ ID NO: 2579) | 0.180 |
| 70 | SVPLLTHPA (SEQ ID NO: 2580) | 0.180 |
| 120 | GSIDTDPPA (SEQ ID NO: 2581) | 0.180 |
| 62 | TLGVVPQAS (SEQ ID NO: 2582) | 0.168 |

TABLE XVI-continued

V4-HLA-A24-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 57 | APLQPTLGV (SEQ ID NO: 2583) | 0.150 |
| 21 | ATPAGPMPC (SEQ ID NO: 2584) | 0.150 |
| 168 | LSQVWSVVS (SEQ ID NO: 2585) | 0.150 |
| 63 | LGVVPQASV (SEQ ID NO: 2586) | 0.150 |
| 172 | WSVVSPAPS (SEQ ID NO: 2587) | 0.150 |
| 163 | HPIYDLSQV (SEQ ID NO: 2588) | 0.150 |
| 129 | DGPSNPLCC (SEQ ID NO: 2589) | 0.150 |
| 140 | HGPAFSTLN (SEQ ID NO: 2590) | 0.150 |
| 106 | DPPMALSRT (SEQ ID NO: 2591) | 0.150 |
| 89 | HPNASLTMY (SEQ ID NO: 2592) | 0.150 |
| 125 | DPPADGPSN (SEQ ID NO: 2593) | 0.150 |
| 38 | CSLHSACCS (SEQ ID NO: 2594) | 0.150 |
| 16 | VTPTCATPA (SEQ ID NO: 2595) | 0.150 |
| 92 | ASLTMYVCA (SEQ ID NO: 2596) | 0.150 |
| 170 | QVWSVVSPA (SEQ ID NO: 2597) | 0.140 |
| 167 | DLSQVWSVV (SEQ ID NO: 2598) | 0.140 |
| 12 | TSRAVTPTC (SEQ ID NO: 2599) | 0.140 |

TABLE XVI-continued

V4-HLA-A24-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 87 | EAHPNASLT (SEQ ID NO: 2600) | 0.120 |
| 104 | HPDPPMALS (SEQ ID NO: 2601) | 0.120 |
| 158 | EAFPAHPIY (SEQ ID NO: 2602) | 0.120 |
| 176 | SPAPSRGQA (SEQ ID NO: 2603) | 0.120 |
| 102 | VPHPDPPMA (SEQ ID NO: 2604) | 0.120 |
| 54 | LWGAPLQPT (SEQ ID NO: 2605) | 0.120 |
| 35 | SLRCSLHSA (SEQ ID NO: 2606) | 0.100 |
| 27 | MPCSRLPPS (SEQ ID NO: 2607) | 0.100 |
| 7 | TWARRTSRA (SEQ ID NO: 2608) | 0.100 |
| 42 | SACCSGDPA (SEQ ID NO: 2609) | 0.100 |
| 91 | NASLTMYVC (SEQ ID NO: 2610) | 0.100 |
| 22 | TPAGPMPCS (SEQ ID NO: 2611) | 0.100 |
| 8 | WARRTSRAV (SEQ ID NO: 2612) | 0.100 |
| 43 | ACCSGDPAS (SEQ ID NO: 2613) | 0.100 |
| 5 | TTTWARRTS (SEQ ID NO: 2614) | 0.100 |
| 1 | MTHRTTTWA (SEQ ID NO: 2615) | 0.100 |
| 130 | GPSNPLCCC (SEQ ID NO: 2616) | 0.100 |

TABLE XVI-continued

V4-HLA-A24-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 44 | CCSGDPASY (SEQ ID NO: 2617) | 0.100 |
| 135 | LCCCFHGPA (SEQ ID NO: 2618) | 0.100 |
| 137 | CCFHGPAFS (SEQ ID NO: 2619) | 0.100 |
| 157 | QEAFPAHPI (SEQ ID NO: 2620) | 0.100 |
| 88 | AHPNASLTM (SEQ ID NO: 2621) | 0.075 |
| 159 | AFPAHPIYD (SEQ ID NO: 2622) | 0.075 |
| 101 | PVPHPDPPM (SEQ ID NO: 2623) | 0.075 |
| 103 | PHPDPPMAL (SEQ ID NO: 2624) | 0.072 |
| 86 | PEAHPNASL (SEQ ID NO: 2625) | 0.040 |
| 181 | RGQALRRAR (SEQ ID NO: 2626) | 0.036 |
| 117 | RQIGSIDTD (SEQ ID NO: 2627) | 0.030 |
| 79 | QWEPVLVPE (SEQ ID NO: 2628) | 0.025 |
| 69 | ASVPLLTHP (SEQ ID NO: 2629) | 0.022 |
| 155 | FPQEAFPAH (SEQ ID NO: 2630) | 0.022 |
| 61 | PTLGVVPQA (SEQ ID NO: 2631) | 0.021 |
| 81 | EPVLVPEAH (SEQ ID NO: 2632) | 0.021 |
| 53 | RLWGAPLQP (SEQ ID NO: 2633) | 0.020 |

TABLE XVI-continued

V4-HLA-A24-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 80 | WEPVLVPEA (SEQ ID NO: 2634) | 0.020 |
| 124 | TDPPADGPS (SEQ ID NO: 2635) | 0.018 |
| 58 | PLQPTLGVV (SEQ ID NO: 2636) | 0.018 |
| 30 | SRLPPSLRC (SEQ ID NO: 2637) | 0.018 |
| 25 | GPMPCSRLP (SEQ ID NO: 2638) | 0.018 |
| 59 | LQPTLGVVP (SEQ ID NO: 2639) | 0.018 |
| 64 | GVVPQASVP (SEQ ID NO: 2640) | 0.018 |
| 100 | APVPHPDPP (SEQ ID NO: 2641) | 0.018 |
| 164 | PIYDLSQVW (SEQ ID NO: 2642) | 0.017 |
| 98 | VCAPVPHPD (SEQ ID NO: 2643) | 0.017 |

TABLE XVI

V19-HLA-A24-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 1 | GPMPCSRLL (SEQ ID NO: 2644) | 7.200 |
| 8 | LLPSLRCSL (SEQ ID NO: 2645) | 7.200 |
| 4 | PCSRLLPSL (SEQ ID NO: 2646) | 0.480 |
| 7 | RLLPSLRCS (SEQ ID NO: 2647) | 0.360 |

TABLE XVI-continued

V19-HLA-A24-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 3 | MPCSRLLPS (SEQ ID NO: 2648) | 0.100 |
| 6 | SRLLPSLRC (SEQ ID NO: 2649) | 0.015 |
| 5 | CSRLLPSLR (SEQ ID NO: 2650) | 0.012 |
| 9 | LPSLRCSLH (SEQ ID NO: 2651) | 0.010 |
| 2 | PMPCSRLLP (SEQ ID NO: 2652) | 0.002 |

TABLE XVI

V20-HLA-A24-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 3 | SGDPASSRL (SEQ ID NO: 2653) | 4.800 |
| 8 | SSRLWGAPL (SEQ ID NO: 2654) | 4.000 |
| 1 | CCSGDPASS (SEQ ID NO: 2655) | 0.100 |
| 4 | GDPASSRLW (SEQ ID NO: 2656) | 0.015 |
| 7 | ASSRLWGAP (SEQ ID NO: 2657) | 0.012 |
| 2 | CSGDPASSR (SEQ ID NO: 2658) | 0.012 |
| 6 | PASSRLWGA (SEQ ID NO: 2659) | 0.010 |
| 5 | DPASSRLWG (SEQ ID NO: 2660) | 0.010 |
| 9 | SRLWGAPLQ (SEQ ID NO: 2661) | 0.002 |

TABLE XVI

V21-HLA-A24-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 9 | DPAQWEPVL (SEQ ID NO: 2662) | 4.000 |
| 3 | SVPLLTDPA (SEQ ID NO: 2663) | 0.180 |
| 2 | ASVPLLTDP (SEQ ID NO: 2664) | 0.022 |
| 8 | TDPAQWEPV (SEQ ID NO: 2665) | 0.015 |
| 5 | PLLTDPAQW (SEQ ID NO: 2666) | 0.015 |
| 4 | VPLLTDPAQ (SEQ ID NO: 2667) | 0.015 |
| 6 | LLTDPAQWE (SEQ ID NO: 2668) | 0.014 |
| 7 | LTDPAQWEP (SEQ ID NO: 2669) | 0.013 |
| 1 | QASVPLLTD (SEQ ID NO: 2670) | 0.010 |

TABLE XVI

V21&22-HLA-A24-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 1 | ASVPLLTDL (SEQ ID NO: 2671) | 8.640 |
| 8 | DLAQWEPVL (SEQ ID NO: 2672) | 4.000 |
| 2 | SVPLLTDLA (SEQ ID NO: 2673) | 0.180 |
| 5 | LLTDLAQWE (SEQ ID NO: 2674) | 0.017 |
| 7 | TDLAQWEPV (SEQ ID NO: 2675) | 0.015 |

TABLE XVI-continued

V21&22-HLA-A24-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 3 | VPLLTDLAQ (SEQ ID NO: 2676) | 0.015 |
| 4 | PLLTDLAQW (SEQ ID NO: 2677) | 0.015 |
| 6 | LTDLAQWEP (SEQ ID NO: 2678) | 0.011 |

TABLE XVI

V22-HLA-A24-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 1 | ASVPLLTHL (SEQ ID NO: 2679) | 8.640 |
| 8 | HLAQWEPVL (SEQ ID NO: 2680) | 4.000 |
| 2 | SVPLLTHLA (SEQ ID NO: 2681) | 0.180 |
| 9 | LAQWEPVLV (SEQ ID NO: 2682) | 0.150 |
| 3 | VPLLTHLAQ (SEQ ID NO: 2683) | 0.015 |
| 4 | PLLTHLAQW (SEQ ID NO: 2684) | 0.015 |
| 7 | THLAQWEPV (SEQ ID NO: 2685) | 0.015 |
| 5 | LLTHLAQWE (SEQ ID NO: 2686) | 0.014 |
| 6 | LTHLAQWEP (SEQ ID NO: 2687) | 0.011 |

TABLE XVI

V24-HLA-A24-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 5 | MYVCTPVPH (SEQ ID NO: 2688) | 0.750 |
| 3 | LTMYVCTPV (SEQ ID NO: 2689) | 0.210 |
| 1 | ASLTMYVCT (SEQ ID NO: 2690) | 0.150 |
| 7 | VCTPVPHPD (SEQ ID NO: 2691) | 0.017 |
| 8 | CTPVPHPDP (SEQ ID NO: 2692) | 0.015 |
| 4 | TMYVCTPVP (SEQ ID NO: 2693) | 0.010 |
| 2 | SLTMYVCTP (SEQ ID NO: 2694) | 0.010 |
| 6 | YVCTPVPHP (SEQ ID NO: 2695) | 0.010 |

TABLE XVI

V25-HLA-A24-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 3 | TPTRQISSI (SEQ ID NO: 2696) | 1.000 |
| 2 | RTPTRQISS (SEQ ID NO: 2697) | 0.300 |
| 9 | SSIDTDPPA (SEQ ID NO: 2698) | 0.180 |
| 6 | RQISSIDTD (SEQ ID NO: 2699) | 0.030 |
| 5 | TRQISSIDT (SEQ ID NO: 2700) | 0.015 |
| 1 | SRTPTRQIS (SEQ ID NO: 2701) | 0.014 |

TABLE XVI-continued

V25-HLA-A24-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 7 | QISSIDTDP (SEQ ID NO: 2702) | 0.014 |
| 8 | ISSIDTDPP (SEQ ID NO: 2703) | 0.010 |
| 4 | PTRQISSID (SEQ ID NO: 2704) | 0.001 |

TABLE XVI

V25&26-HLA-A24-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 7 | SSSDTDPPA (SEQ ID NO: 2705) | 0.012 |
| 1 | TPTRQISSS (SEQ ID NO: 2706) | 0.100 |
| 4 | RQISSSDTD (SEQ ID NO: 2707) | 0.030 |
| 3 | TRQISSSDT (SEQ ID NO: 2708) | 0.015 |
| 6 | ISSSDTDPP (SEQ ID NO: 2709) | 0.010 |
| 5 | QISSSDTDP (SEQ ID NO: 2710) | 0.010 |
| 2 | PTRQISSSD (SEQ ID NO: 2711) | 0.001 |

TABLE XVI

V26-HLA-A24-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 7 | GSSDTDPPA (SEQ ID NO: 2712) | 0.120 |

TABLE XVI-continued

V26-HLA-A24-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 1 | TPTRQIGSS (SEQ ID NO: 2713) | 0.100 |
| 4 | RQIGSSDTD (SEQ ID NO: 2714) | 0.030 |
| 3 | TRQIGSSDT (SEQ ID NO: 2715) | 0.015 |
| 8 | SSDTDPPAD (SEQ ID NO: 2716) | 0.010 |
| 6 | IGSSDTDPP (SEQ ID NO: 2717) | 0.010 |
| 5 | QIGSSDTDP (SEQ ID NO: 2718) | 0.010 |
| 2 | PTRQIGSSD (SEQ ID NO: 2719) | 0.001 |
| 9 | SDTDPPADG (SEQ ID NO: 2720) | 0.001 |

TABLE XVI

V27-HLA-A24-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 2 | RGQALRRAQ (SEQ ID NO: 2721) | 0.036 |
| 1 | SRGQALRRA (SEQ ID NO: 2722) | 0.010 |

TABLE XVII

V1-HLA-A24-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 82 | KNITCCDTDL (SEQ ID NO: 2723) | 12.000 |

TABLE XVII-continued

V1-HLA-A24-10MERS-PSCA
Each peptide is a portion of SEQ ID NO: 2;
each start position is specified, the
length of peptide is 10 amino acids, and
the end position for each peptide is the
start position plus nine.

| START | SUBSEQUENCE | SCORE |
|---|---|---|
| 27 | KAQVSNEDCL (SEQ ID NO: 2724) | 12.000 |
| 108 | ALLPALGLLL (SEQ ID NO: 2725) | 8.640 |
| 77 | YYVGKKNITC (SEQ ID NO: 2726) | 7.500 |
| 4 | VLLALLMAGL (SEQ ID NO: 2727) | 7.200 |
| 104 | AAILALLPAL (SEQ ID NO: 2728) | 7.200 |
| 98 | HALQPAAAIL (SEQ ID NO: 2729) | 6.000 |
| 76 | DYYVGKKNIT (SEQ ID NO: 2730) | 6.000 |
| 6 | LALLMAGLAL (SEQ ID NO: 2731) | 6.000 |
| 91 | LCNASGAHAL (SEQ ID NO: 2732) | 6.000 |
| 35 | CLQVENCTQL (SEQ ID NO: 2733) | 6.000 |
| 100 | LQPAAAILAL (SEQ ID NO: 2734) | 6.000 |
| 59 | LTVISKGCSL (SEQ ID NO: 2735) | 6.000 |
| 13 | LALQPGTALL (SEQ ID NO: 2736) | 6.000 |
| 114 | GLLLWGPGQL (SEQ ID NO: 2737) | 6.000 |
| 107 | LALLPALGLL (SEQ ID NO: 2738) | 6.000 |
| 101 | QPAAAILALL (SEQ ID NO: 2739) | 5.600 |
| 23 | CYSCKAQVSN (SEQ ID NO: 2740) | 5.000 |
| 106 | ILALLPALGL (SEQ ID NO: 2741) | 4.000 |
| 50 | TARIRAVGLL (SEQ ID NO: 2742) | 4.000 |
| 49 | WTARIRAVGL (SEQ ID NO: 2743) | 4.000 |
| 12 | GLALQPGTAL (SEQ ID NO: 2744) | 4.000 |
| 44 | LGEQCWTARI (SEQ ID NO: 2745) | 1.500 |
| 54 | RAVGLLTVIS (SEQ ID NO: 2746) | 0.360 |
| 2 | KAVLLALLMA (SEQ ID NO: 2747) | 0.300 |
| 31 | SNEDCLQVEN (SEQ ID NO: 2748) | 0.238 |
| 57 | GLLTVISKGC (SEQ ID NO: 2749) | 0.210 |
| 52 | RIRAVGLLTV (SEQ ID NO: 2750) | 0.200 |
| 99 | ALQPAAAILA (SEQ ID NO: 2751) | 0.180 |
| 69 | NCVDDSQDYY (SEQ ID NO: 2752) | 0.180 |
| 14 | ALQPGTALLC (SEQ ID NO: 2753) | 0.180 |
| 19 | TALLCYSCKA (SEQ ID NO: 2754) | 0.165 |
| 74 | SQDYYVGKKN (SEQ ID NO: 2755) | 0.154 |
| 109 | LLPALGLLLW (SEQ ID NO: 2756) | 0.150 |
| 60 | TVISKGCSLN (SEQ ID NO: 2757) | 0.150 |

TABLE XVII-continued

V1-HLA-A24-10MERS-PSCA
Each peptide is a portion of SEQ ID NO: 2;
each start position is specified, the
length of peptide is 10 amino acids, and
the end position for each peptide is the
start position plus nine.

| START | SUBSEQUENCE | SCORE |
|---|---|---|
| 15 | LQPGTALLCY (SEQ ID NO: 2758) | 0.150 |
| 42 | TQLGEQCWTA (SEQ ID NO: 2759) | 0.150 |
| 41 | CTQLGEQCWT (SEQ ID NO: 2760) | 0.150 |
| 11 | AGLALQPGTA (SEQ ID NO: 2761) | 0.150 |
| 86 | CCDTDLCNAS (SEQ ID NO: 2762) | 0.144 |
| 85 | TCCDTDLCNA (SEQ ID NO: 2763) | 0.120 |
| 62 | ISKGCSLNCV (SEQ ID NO: 2764) | 0.120 |
| 70 | CVDDSQDYYV (SEQ ID NO: 2765) | 0.120 |
| 39 | ENCTQLGEQC (SEQ ID NO: 2766) | 0.120 |
| 68 | LNCVDDSQDY (SEQ ID NO: 2767) | 0.120 |
| 40 | NCTQLGEQCW (SEQ ID NO: 2768) | 0.120 |
| 53 | IRAVGLLTVI (SEQ ID NO: 2769) | 0.120 |
| 94 | ASGAHALQPA (SEQ ID NO: 2770) | 0.120 |
| 95 | SGAHALQPAA (SEQ ID NO: 2771) | 0.120 |
| 22 | LCYSCKAQVS (SEQ ID NO: 2772) | 0.120 |
| 16 | QPGTALLCYS (SEQ ID NO: 2773) | 0.120 |
| 10 | MAGLALQPGT (SEQ ID NO: 2774) | 0.120 |

TABLE XVII-continued

V1-HLA-A24-10MERS-PSCA
Each peptide is a portion of SEQ ID NO: 2;
each start position is specified, the
length of peptide is 10 amino acids, and
the end position for each peptide is the
start position plus nine.

| START | SUBSEQUENCE | SCORE |
|---|---|---|
| 47 | QCWTARIRAV (SEQ ID NO: 2775) | 0.100 |
| 61 | VISKGCSLNC (SEQ ID NO: 2776) | 0.100 |
| 97 | AHALQPAAAI (SEQ ID NO: 2777) | 0.100 |
| 88 | DTDLCNASGA (SEQ ID NO: 2778) | 0.100 |
| 78 | YVGKKNITCC (SEQ ID NO: 2779) | 0.100 |
| 5 | LLALLMAGLA (SEQ ID NO: 2780) | 0.100 |
| 75 | QDYYVGKKNI (SEQ ID NO: 2781) | 0.100 |
| 84 | ITCCDTDLCN (SEQ ID NO: 2782) | 0.100 |
| 83 | NITCCDTDLC (SEQ ID NO: 2783) | 0.100 |
| 90 | DLCNASGAHA (SEQ ID NO: 2784) | 0.100 |
| 58 | LLTVISKGCS (SEQ ID NO: 2785) | 0.100 |
| 65 | GCSLNCVDDS (SEQ ID NO: 2786) | 0.100 |
| 103 | AAAILALLPA (SEQ ID NO: 2787) | 0.100 |
| 21 | LLCYSCKAQV (SEQ ID NO: 2788) | 0.100 |
| 46 | EQCWTARIRA (SEQ ID NO: 2789) | 0.100 |
| 96 | GAHALQPAAA (SEQ ID NO: 2790) | 0.100 |
| 29 | QVSNEDCLQV (SEQ ID NO: 2791) | 0.100 |

TABLE XVII-continued

V1-HLA-A24-10MERS-PSCA
Each peptide is a portion of SEQ ID NO: 2;
each start position is specified, the
length of peptide is 10 amino acids, and
the end position for each peptide is the
start position plus nine.

| START | SUBSEQUENCE | SCORE |
|---|---|---|
| 1 | MKAVLLALLM (SEQ ID NO: 2792) | 0.060 |
| 56 | VGLLTVISKG (SEQ ID NO: 2793) | 0.023 |
| 36 | LQVENCTQLG (SEQ ID NO: 2794) | 0.022 |
| 30 | VSNEDCLQVE (SEQ ID NO: 2795) | 0.022 |
| 51 | ARIRAVGLLT (SEQ ID NO: 2796) | 0.021 |
| 66 | CSLNCVDDSQ (SEQ ID NO: 2797) | 0.021 |
| 64 | KGCSLNCVDD (SEQ ID NO: 2798) | 0.020 |
| 73 | DSQDYYVGKK (SEQ ID NO: 2799) | 0.020 |
| 25 | SCKAQVSNED (SEQ ID NO: 2800) | 0.018 |
| 8 | LLMAGLALQP (SEQ ID NO: 2801) | 0.018 |
| 3 | AVLLALLMAG (SEQ ID NO: 2802) | 0.018 |
| 105 | AILALLPALG (SEQ ID NO: 2803) | 0.018 |
| 33 | EDCLQVENCT (SEQ ID NO: 2804) | 0.017 |
| 20 | ALLCYSCKAQ (SEQ ID NO: 2805) | 0.015 |
| 28 | AQVSNEDCLQ (SEQ ID NO: 2806) | 0.015 |
| 67 | SLNCVDDSQD (SEQ ID NO: 2807) | 0.015 |
| 113 | LGLLLWGPGQ (SEQ ID NO: 2808) | 0.015 |
| 34 | DCLQVENCTQ (SEQ ID NO: 2809) | 0.015 |
| 37 | QVENCTQLGE (SEQ ID NO: 2810) | 0.015 |
| 7 | ALLMAGLALQ (SEQ ID NO: 2811) | 0.015 |
| 48 | CWTARIRAVG (SEQ ID NO: 2812) | 0.014 |
| 79 | VGKKNITCCD (SEQ ID NO: 2813) | 0.014 |
| 112 | ALGLLLWGPG (SEQ ID NO: 2814) | 0.012 |
| 17 | PGTALLCYSC (SEQ ID NO: 2815) | 0.012 |
| 43 | QLGEQCWTAR (SEQ ID NO: 2816) | 0.012 |
| 9 | LMAGLALQPG (SEQ ID NO: 2817) | 0.012 |
| 110 | LPALGLLLWG (SEQ ID NO: 2818) | 0.012 |
| 32 | NEDCLQVENC (SEQ ID NO: 2819) | 0.010 |
| 93 | NASGAHALQP (SEQ ID NO: 2820) | 0.010 |
| 92 | CNASGAHALQ (SEQ ID NO: 2821) | 0.010 |
| 80 | GKKNITCCDT (SEQ ID NO: 2822) | 0.010 |

TABLE XVII

V4-HLA-A24-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 159 | AFPAHPIYDL (SEQ ID NO: 2823) | 30.000 |
| 138 | CFHGPAFSTL (SEQ ID NO: 2824) | 24.000 |
| 31 | RLPPSLRCSL (SEQ ID NO: 2825) | 17.280 |
| 145 | STLNPVLRHL (SEQ ID NO: 2826) | 8.400 |
| 64 | GVVPQASVPL (SEQ ID NO: 2827) | 7.200 |
| 85 | VPEAHPNASL (SEQ ID NO: 2828) | 6.000 |
| 65 | VVPQASVPLL (SEQ ID NO: 2829) | 6.000 |
| 176 | SPAPSRGQAL (SEQ ID NO: 2830) | 5.760 |
| 165 | IYDLSQVWSV (SEQ ID NO: 2831) | 5.000 |
| 102 | VPHPDPPMAL (SEQ ID NO: 2832) | 4.800 |
| 27 | MPCSRLPPSL (SEQ ID NO: 2833) | 4.800 |
| 45 | CSGDPASYRL (SEQ ID NO: 2834) | 4.800 |
| 54 | LWGAPLQPTL (SEQ ID NO: 2835) | 4.800 |
| 146 | TLNPVLRHLF (SEQ ID NO: 2836) | 4.320 |
| 50 | ASYRLWGAPL (SEQ ID NO: 2837) | 4.000 |
| 113 | RTPTRQIGSI (SEQ ID NO: 2838) | 3.000 |
| 130 | GPSNPLCCCF (SEQ ID NO: 2839) | 2.400 |
| 135 | LCCCFHGPAF (SEQ ID NO: 2840) | 2.000 |
| 110 | ALSRTPTRQI (SEQ ID NO: 2841) | 1.000 |
| 100 | APVPHPDPPM (SEQ ID NO: 2842) | 0.900 |
| 96 | MYVCAPVPHP (SEQ ID NO: 2843) | 0.750 |
| 75 | THPAQWEPVL (SEQ ID NO: 2844) | 0.600 |
| 87 | EAHPNASLTM (SEQ ID NO: 2845) | 0.600 |
| 126 | PPADGPSNPL (SEQ ID NO: 2846) | 0.576 |
| 51 | SYRLWGAPLQ (SEQ ID NO: 2847) | 0.500 |
| 142 | PAFSTLNPVL (SEQ ID NO: 2848) | 0.480 |
| 23 | PAGPMPCSRL (SEQ ID NO: 2849) | 0.480 |
| 11 | RTSRAVTPTC (SEQ ID NO: 2850) | 0.280 |
| 53 | RLWGAPLQPT (SEQ ID NO: 2851) | 0.240 |
| 79 | QWEPVLVPEA (SEQ ID NO: 2852) | 0.238 |
| 84 | LVPEAHPNAS (SEQ ID NO: 2853) | 0.216 |
| 69 | ASVPLLTHPA (SEQ ID NO: 2854) | 0.216 |
| 163 | HPIYDLSQVW (SEQ ID NO: 2855) | 0.216 |
| 66 | VPQASVPLLT (SEQ ID NO: 2856) | 0.210 |

TABLE XVII-continued

V4-HLA-A24-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 169 | SQVWSVVSPA (SEQ ID NO: 2857) | 0.210 |
| 4 | RTTTWARRTS (SEQ ID NO: 2858) | 0.200 |
| 37 | RCSLHSACCS (SEQ ID NO: 2859) | 0.200 |
| 151 | LRHLFPQEAF (SEQ ID NO: 2860) | 0.200 |
| 83 | VLVPEAHPNA (SEQ ID NO: 2861) | 0.180 |
| 89 | HPNASLTMYV (SEQ ID NO: 2862) | 0.180 |
| 71 | VPLLTHPAQW (SEQ ID NO: 2863) | 0.150 |
| 56 | GAPLQPTLGV (SEQ ID NO: 2864) | 0.150 |
| 156 | PQEAFPAHPI (SEQ ID NO: 2865) | 0.150 |
| 57 | APLQPTLGVV (SEQ ID NO: 2866) | 0.150 |
| 129 | DGPSNPLCCC (SEQ ID NO: 2867) | 0.150 |
| 21 | ATPAGPMPCS (SEQ ID NO: 2868) | 0.150 |
| 175 | VSPAPSRGQA (SEQ ID NO: 2869) | 0.150 |
| 60 | QPTLGVVPQA (SEQ ID NO: 2870) | 0.140 |
| 93 | SLTMYVCAPV (SEQ ID NO: 2871) | 0.140 |
| 160 | FPAHPIYDLS (SEQ ID NO: 2872) | 0.140 |
| 150 | VLRHLFPQEA (SEQ ID NO: 2873) | 0.132 |

TABLE XVII-continued

V4-HLA-A24-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 46 | SGDPASYRLW (SEQ ID NO: 2874) | 0.120 |
| 123 | DTDPPADGPS (SEQ ID NO: 2875) | 0.120 |
| 35 | SLRCSLHSAC (SEQ ID NO: 2876) | 0.120 |
| 15 | AVTPTCATPA (SEQ ID NO: 2877) | 0.120 |
| 20 | CATPAGPMPC (SEQ ID NO: 2878) | 0.120 |
| 141 | GPAFSTLNPV (SEQ ID NO: 2879) | 0.120 |
| 74 | LTHPAQWEPV (SEQ ID NO: 2880) | 0.120 |
| 153 | HLFPQEAFPA (SEQ ID NO: 2881) | 0.120 |
| 8 | WARRTSRAVT (SEQ ID NO: 2882) | 0.100 |
| 136 | CCCFHGPAFS (SEQ ID NO: 2883) | 0.100 |
| 42 | SACCSGDPAS (SEQ ID NO: 2884) | 0.100 |
| 171 | VWSVVSPAPS (SEQ ID NO: 2885) | 0.100 |
| 76 | HPAQWEPVLV (SEQ ID NO: 2886) | 0.100 |
| 6 | TTWARRTSRA (SEQ ID NO: 2887) | 0.100 |
| 167 | DLSQVWSVVS (SEQ ID NO: 2888) | 0.100 |
| 29 | CSRLPPSLRC (SEQ ID NO: 2889) | 0.100 |
| 41 | HSACCSGDPA (SEQ ID NO: 2890) | 0.100 |

TABLE XVII-continued

V4-HLA-A24-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 48 | DPASYRLWGA (SEQ ID NO: 2891) | 0.100 |
| 119 | IGSIDTDPPA (SEQ ID NO: 2892) | 0.100 |
| 43 | ACCSGDPASY (SEQ ID NO: 2893) | 0.100 |
| 62 | TLGVVPQASV (SEQ ID NO: 2894) | 0.100 |
| 137 | CCFHGPAFST (SEQ ID NO: 2895) | 0.100 |
| 12 | TSRAVTPTCA (SEQ ID NO: 2896) | 0.100 |
| 91 | NASLTMYVCA (SEQ ID NO: 2897) | 0.100 |
| 7 | TWARRTSRAV (SEQ ID NO: 2898) | 0.100 |
| 154 | LFPQEAFPAH (SEQ ID NO: 2899) | 0.090 |
| 18 | PTCATPAGPM (SEQ ID NO: 2900) | 0.050 |
| 143 | AFSTLNPVLR (SEQ ID NO: 2901) | 0.050 |
| 117 | RQIGSIDTDP (SEQ ID NO: 2902) | 0.042 |
| 14 | RAVTPTCATP (SEQ ID NO: 2903) | 0.030 |
| 61 | PTLGVVPQAS (SEQ ID NO: 2904) | 0.025 |
| 166 | YDLSQVWSVV (SEQ ID NO: 2905) | 0.021 |
| 10 | RRTSRAVTPT (SEQ ID NO: 2906) | 0.020 |
| 124 | TDPPADGPSN (SEQ ID NO: 2907) | 0.018 |
| 30 | SRLPPSLRCS (SEQ ID NO: 2908) | 0.018 |
| 25 | GPMPCSRLPP (SEQ ID NO: 2909) | 0.018 |
| 155 | FPQEAFPAHP (SEQ ID NO: 2910) | 0.018 |
| 106 | DPPMALSRTP (SEQ ID NO: 2911) | 0.018 |
| 133 | NPLCCCFHGP (SEQ ID NO: 2912) | 0.018 |
| 120 | GSIDTDPPAD (SEQ ID NO: 2913) | 0.018 |
| 78 | AQWEPVLVPE (SEQ ID NO: 2914) | 0.017 |
| 101 | PVPHPPPPMA (SEQ ID NO: 2915) | 0.015 |
| 24 | AGPMPCSRLP (SEQ ID NO: 2916) | 0.015 |
| 94 | LTMYVCAPVP (SEQ ID NO: 2917) | 0.015 |
| 99 | CAPVPHPDPP (SEQ ID NO: 2918) | 0.015 |
| 140 | HGPAFSTLNP (SEQ ID NO: 2919) | 0.015 |
| 34 | PSLRCSLHSA (SEQ ID NO: 2920) | 0.015 |
| 107 | PPMALSRTPT (SEQ ID NO: 2921) | 0.015 |
| 147 | LNPVLRHLFP (SEQ ID NO: 2922) | 0.015 |

TABLE XVII

V19-HLA-A24-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 8 | RLLPSLRCSL (SEQ ID NO: 2923) | 17.280 |
| 1 | AGPMPCSRLL (SEQ ID NO: 2924) | 6.000 |
| 4 | MPCSRLLPSL (SEQ ID NO: 2925) | 4.800 |
| 6 | CSRLLPSLRC (SEQ ID NO: 2926) | 0.100 |
| 10 | LPSLRCSLHS (SEQ ID NO: 2927) | 0.100 |
| 2 | GPMPCSRLLP (SEQ ID NO: 2928) | 0.018 |
| 7 | SRLLPSLRCS (SEQ ID NO: 2929) | 0.015 |
| 3 | PMPCSRLLPS (SEQ ID NO: 2930) | 0.015 |
| 9 | LLPSLRCSLH (SEQ ID NO: 2931) | 0.015 |
| 5 | PCSRLLPSLR (SEQ ID NO: 2932) | 0.001 |

TABLE XVII

V20-HLA-A24-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 3 | CSGDPASSRL (SEQ ID NO: 2933) | 4.800 |
| 8 | ASSRLWGAPL (SEQ ID NO: 2934) | 4.000 |
| 4 | SGDPASSRLW (SEQ ID NO: 2935) | 0.120 |
| 6 | DPASSRLWGA (SEQ ID NO: 2936) | 0.100 |
| 1 | ACCSGDPASS (SEQ ID NO: 2937) | 0.100 |
| 9 | SSRLWGAPLQ (SEQ ID NO: 2938) | 0.010 |
| 2 | CCSGDPASSR (SEQ ID NO: 2939) | 0.010 |
| 10 | SRLWGAPLQP (SEQ ID NO: 2940) | 0.002 |
| 5 | GDPASSRLWG (SEQ ID NO: 2941) | 0.002 |
| 7 | PASSRLWGAP (SEQ ID NO: 2942) | 0.001 |

TABLE XVII

V21-HLA-A24-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 9 | TDPAQWEPVL (SEQ ID NO: 2943) | 0.600 |
| 3 | ASVPLLTDPA (SEQ ID NO: 2944) | 0.216 |
| 5 | VPLLTDPAQW (SEQ ID NO: 2945) | 0.150 |
| 8 | LTDPAQWEPV (SEQ ID NO: 2946) | 0.120 |
| 10 | DPAQWEPVLV (SEQ ID NO: 2947) | 0.100 |
| 4 | SVPLLTDPAQ (SEQ ID NO: 2948) | 0.015 |
| 7 | LLTDPAQWEP (SEQ ID NO: 2949) | 0.013 |
| 2 | QASVPLLTDP (SEQ ID NO: 2950) | 0.012 |

TABLE XVII-continued

V21-HLA-A24-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 6 | PLLTDPAQWE (SEQ ID NO: 2951) | 0.002 |
| 1 | PQASVPLLTD (SEQ ID NO: 2952) | 0.001 |

TABLE XVII

V21&22-HLA-A24-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 1 | QASVPLLTDL (SEQ ID NO: 2953) | 4.800 |
| 8 | TDLAQWEPVL (SEQ ID NO: 2954) | 0.600 |
| 2 | ASVPLLTDLA (SEQ ID NO: 2955) | 0.216 |
| 4 | VPLLTDLAQW (SEQ ID NO: 2956) | 0.150 |
| 7 | LTDLAQWEPV (SEQ ID NO: 2957) | 0.100 |
| 9 | DLAQWEPVLV (SEQ ID NO: 2958) | 0.100 |
| 3 | SVPLLTDLAQ (SEQ ID NO: 2959) | 0.015 |
| 6 | LLTDLAQWEP (SEQ ID NO: 2960) | 0.013 |
| 5 | PLLTDLAQWE (SEQ ID NO: 2961) | 0.002 |

TABLE XVII

V22-HLA-A24-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 1 | QASVPLLTHL (SEQ ID NO: 2962) | 4.800 |
| 8 | THLAQWEPVL (SEQ ID NO: 2963) | 0.600 |
| 2 | ASVPLLTHLA (SEQ ID NO: 2964) | 0.216 |
| 4 | VPLLTHLAQW (SEQ ID NO: 2965) | 0.150 |
| 7 | LTHLAQWEPV (SEQ ID NO: 2966) | 0.100 |
| 9 | HLAQWEPVLV (SEQ ID NO: 2967) | 0.100 |
| 10 | LAQWEPVLVP (SEQ ID NO: 2968) | 0.015 |
| 3 | SVPLLTHLAQ (SEQ ID NO: 2969) | 0.015 |
| 6 | LLTHLAQWEP (SEQ ID NO: 2970) | 0.011 |
| 5 | PLLTHLAQWE (SEQ ID NO: 2971) | 0.002 |

TABLE XVII

V24-HLA-A24-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 10 | TPVPHPDPPM (SEQ ID NO: 2972) | 0.900 |
| 6 | MYVCTPVPHP (SEQ ID NO: 2973) | 0.750 |
| 3 | SLTMYVCTPV (SEQ ID NO: 2974) | 0.140 |
| 1 | NASLTMYVCT (SEQ ID NO: 2975) | 0.100 |

TABLE XVII-continued

V24-HLA-A24-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 9 | CTPVPHPDPP (SEQ ID NO: 2976) | 0.015 |
| 4 | LTMYVCTPVP (SEQ ID NO: 2977) | 0.015 |
| 2 | ASLTMYVCTP (SEQ ID NO: 2978) | 0.015 |
| 7 | YVCTPVPHPD (SEQ ID NO: 2979) | 0.014 |
| 8 | VCTPVPHPDP (SEQ ID NO: 2980) | 0.012 |
| 5 | TMYVCTPVPH (SEQ ID NO: 2981) | 0.010 |

TABLE XVII

V25-HLA-A24-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 3 | RTPTRQISSI (SEQ ID NO: 2982) | 3.000 |
| 1 | LSRTPTRQIS (SEQ ID NO: 2983) | 0.120 |
| 9 | ISSIDTDPPA (SEQ ID NO: 2984) | 0.100 |
| 7 | RQISSIDTDP (SEQ ID NO: 2985) | 0.042 |
| 10 | SSIDTDPPAD (SEQ ID NO: 2986) | 0.018 |
| 4 | TPTRQISSID (SEQ ID NO: 2987) | 0.014 |
| 2 | SRTPTRQISS (SEQ ID NO: 2988) | 0.012 |
| 8 | QISSIDTDPP (SEQ ID NO: 2989) | 0.010 |

TABLE XVII-continued

V25-HLA-A24-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 5 | PTRQISSIDT (SEQ ID NO: 2990) | 0.010 |
| 6 | TRQISSIDTD (SEQ ID NO: 2991) | 0.002 |

TABLE XVII

V26-HLA-A24-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 1 | RTPTRQISSS (SEQ ID NO: 2992) | 0.300 |
| 7 | ISSSDTDPPA (SEQ ID NO: 2993) | 0.100 |
| 5 | RQISSSDTDP (SEQ ID NO: 2994) | 0.030 |
| 2 | TPTRQISSSD (SEQ ID NO: 2995) | 0.014 |
| 8 | SSSDTDPPAD (SEQ ID NO: 2996) | 0.012 |
| 6 | QISSSDTDPP (SEQ ID NO: 2997) | 0.010 |
| 3 | PTRQISSSDT (SEQ ID NO: 2998) | 0.010 |
| 4 | TRQISSSDTD (SEQ ID NO: 2999) | 0.002 |

TABLE XVII

V27-HLA-A24-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 1 | PSRGQALRRA (SEQ ID NO: 3000) | 0.010 |

TABLE XVII-continued

V27-HLA-A24-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 2 | SRGQALRRAQ (SEQ ID NO: 3001) | 0.001 |

TABLE XVIII

V1-HLA-B7-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 50 | TARIRAVGL (SEQ ID NO: 3002) | 120.000 |
| 101 | QPAAAILAL (SEQ ID NO: 3003) | 80.000 |
| 60 | TVISKGCSL (SEQ ID NO: 3004) | 20.000 |
| 13 | LALQPGTAL (SEQ ID NO: 3005) | 18.000 |
| 107 | LALLPALGL (SEQ ID NO: 3006) | 18.000 |
| 28 | AQVSNEDCL (SEQ ID NO: 3007) | 12.000 |
| 105 | AILALLPAL (SEQ ID NO: 3008) | 12.000 |
| 108 | ALLPALGLL (SEQ ID NO: 3009) | 12.000 |
| 99 | ALQPAAAIL (SEQ ID NO: 3010) | 12.000 |
| 7 | ALLMAGLAL (SEQ ID NO: 3011) | 12.000 |
| 14 | ALQPGTALL (SEQ ID NO: 3012) | 12.000 |
| 92 | CNASGAHAL (SEQ ID NO: 3013) | 4.000 |
| 36 | LQVENCTQL (SEQ ID NO: 3014) | 4.000 |

TABLE XVIII-continued

V1-HLA-B7-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 83 | NITCCDTDL (SEQ ID NO: 3015) | 4.000 |
| 109 | LLPALGLLL (SEQ ID NO: 3016) | 4.000 |
| 5 | LLALLMAGL (SEQ ID NO: 3017) | 4.000 |
| 115 | LLLWGPGQL (SEQ ID NO: 3018) | 4.000 |
| 2 | KAVLLALLM (SEQ ID NO: 3019) | 3.000 |
| 98 | HALQPAAAI (SEQ ID NO: 3020) | 1.800 |
| 3 | AVLLALLMA (SEQ ID NO: 3021) | 1.500 |
| 102 | PAAAILALL (SEQ ID NO: 3022) | 1.200 |
| 54 | RAVGLLTVI (SEQ ID NO: 3023) | 1.200 |
| 51 | ARIRAVGLL (SEQ ID NO: 3024) | 1.200 |
| 52 | RIRAVGLLT (SEQ ID NO: 3025) | 1.000 |
| 104 | AAILALLPA (SEQ ID NO: 3026) | 0.900 |
| 78 | YVGKKNITC (SEQ ID NO: 3027) | 0.500 |
| 16 | QPGTALLCY (SEQ ID NO: 3028) | 0.400 |
| 110 | LPALGLLLW (SEQ ID NO: 3029) | 0.400 |
| 1 | MKAVLLALL (SEQ ID NO: 3030) | 0.400 |
| 55 | AVGLLTVIS (SEQ ID NO: 3031) | 0.300 |

TABLE XVIII-continued

V1-HLA-B7-9MERS-PSCA
Each peptide is a portion of SEQ ID NO: 2;
each start position is specified, the
length of peptide is 9 amino acids, and
the end position for each peptide is the
start position plus eight.

| START | SUBSEQUENCE | SCORE |
|---|---|---|
| 96 | GAHALQPAA (SEQ ID NO: 3032) | 0.300 |
| 11 | AGLALQPGT (SEQ ID NO: 3033) | 0.300 |
| 20 | ALLCYSCKA (SEQ ID NO: 3034) | 0.300 |
| 6 | LALLMAGLA (SEQ ID NO: 3035) | 0.300 |
| 27 | KAQVSNEDC (SEQ ID NO: 3036) | 0.300 |
| 22 | LCYSCKAQV (SEQ ID NO: 3037) | 0.200 |
| 30 | VSNEDCLQV (SEQ ID NO: 3038) | 0.200 |
| 47 | QCWTARIRA (SEQ ID NO: 3039) | 0.150 |
| 34 | DCLQVENCT (SEQ ID NO: 3040) | 0.100 |
| 18 | GTALLCYSC (SEQ ID NO: 3041) | 0.100 |
| 15 | LQPGTALLC (SEQ ID NO: 3042) | 0.100 |
| 62 | ISKGCSLNC (SEQ ID NO: 3043) | 0.100 |
| 95 | SGAHALQPA (SEQ ID NO: 3044) | 0.100 |
| 79 | VGKKNITCC (SEQ ID NO: 3045) | 0.100 |
| 40 | NCTQLGEQC (SEQ ID NO: 3046) | 0.100 |
| 43 | QLGEQCWTA (SEQ ID NO: 3047) | 0.100 |
| 100 | LQPAAAILA (SEQ ID NO: 3048) | 0.100 |

TABLE XVIII-continued

V1-HLA-B7-9MERS-PSCA
Each peptide is a portion of SEQ ID NO: 2;
each start position is specified, the
length of peptide is 9 amino acids, and
the end position for each peptide is the
start position plus eight.

| START | SUBSEQUENCE | SCORE |
|---|---|---|
| 84 | ITCCDTDLC (SEQ ID NO: 3049) | 0.100 |
| 91 | LCNASGAHA (SEQ ID NO: 3050) | 0.100 |
| 42 | TQLGEQCWT (SEQ ID NO: 3051) | 0.100 |
| 12 | GLALQPGTA (SEQ ID NO: 3052) | 0.100 |
| 58 | LLTVISKGC (SEQ ID NO: 3053) | 0.100 |
| 103 | AAAILALLP (SEQ ID NO: 3054) | 0.090 |
| 29 | QVSNEDCLQ (SEQ ID NO: 3055) | 0.050 |
| 45 | GEQCWTARI (SEQ ID NO: 3056) | 0.040 |
| 76 | DYYVGKKNI (SEQ ID NO: 3057) | 0.040 |
| 94 | ASGAHALQP (SEQ ID NO: 3058) | 0.030 |
| 112 | ALGLLLWGP (SEQ ID NO: 3059) | 0.030 |
| 97 | AHALQPAAA (SEQ ID NO: 3060) | 0.030 |
| 70 | CVDDSQDYY (SEQ ID NO: 3061) | 0.030 |
| 8 | LLMAGLALQ (SEQ ID NO: 3062) | 0.030 |
| 10 | MAGLALQPG (SEQ ID NO: 3063) | 0.030 |
| 93 | NASGAHALQ (SEQ ID NO: 3064) | 0.030 |
| 19 | TALLCYSCK (SEQ ID NO: 3065) | 0.030 |
| 86 | CCDTDLCNA (SEQ ID NO: 3066) | 0.030 |
| 69 | NCVDDSQDY (SEQ ID NO: 3067) | 0.020 |

TABLE XVIII-continued

V1-HLA-B7-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 63 | SKGCSLNCV (SEQ ID NO: 3068) | 0.020 |
| 41 | CTQLGEQCW (SEQ ID NO: 3069) | 0.020 |
| 59 | LTVISKGCS (SEQ ID NO: 3070) | 0.020 |
| 85 | TCCDTDLCN (SEQ ID NO: 3071) | 0.020 |
| 61 | VISKGCSLN (SEQ ID NO: 3072) | 0.020 |
| 66 | CSLNCVDDS (SEQ ID NO: 3073) | 0.020 |
| 53 | IRAVGLLTV (SEQ ID NO: 3074) | 0.020 |
| 48 | CWTARIRAV (SEQ ID NO: 3075) | 0.020 |
| 24 | YSCKAQVSN (SEQ ID NO: 3076) | 0.020 |
| 37 | QVENCTQLG (SEQ ID NO: 3077) | 0.015 |
| 49 | WTARIRAVG (SEQ ID NO: 3078) | 0.015 |
| 33 | EDCLQVENC (SEQ ID NO: 3079) | 0.010 |
| 46 | EQCWTARIR (SEQ ID NO: 3080) | 0.010 |
| 64 | KGCSLNCVD (SEQ ID NO: 3081) | 0.010 |
| 65 | GCSLNCVDD (SEQ ID NO: 3082) | 0.010 |
| 113 | LGLLLWGPG (SEQ ID NO: 3083) | 0.010 |
| 57 | GLLTVISKG (SEQ ID NO: 3084) | 0.010 |
| 35 | CLQVENCTQ (SEQ ID NO: 3085) | 0.010 |
| 21 | LLCYSCKAQ (SEQ ID NO: 3086) | 0.010 |
| 67 | SLNCVDDSQ (SEQ ID NO: 3087) | 0.010 |
| 90 | DLCNASGAH (SEQ ID NO: 3088) | 0.010 |
| 81 | KKNITCCDT (SEQ ID NO: 3089) | 0.010 |
| 39 | ENCTQLGEQ (SEQ ID NO: 3090) | 0.010 |

TABLE XVIII-continued

V1-HLA-B7-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 114 | GLLLWGPGQ (SEQ ID NO: 3091) | 0.010 |
| 73 | DSQDYYVGK (SEQ ID NO: 3092) | 0.010 |
| 9 | LMAGLALQP (SEQ ID NO: 3093) | 0.010 |
| 25 | SCKAQVSNE (SEQ ID NO: 3094) | 0.010 |
| 68 | LNCVDDSQD (SEQ ID NO: 3095) | 0.010 |
| 106 | ILALLPALG (SEQ ID NO: 3096) | 0.010 |
| 89 | TDLCNASGA (SEQ ID NO: 3097) | 0.010 |
| 77 | YVGKKNIT (SEQ ID NO: 3098) | 0.010 |
| 4 | VLLALLMAG (SEQ ID NO: 3099) | 0.010 |
| 56 | VGLLTVISK (SEQ ID NO: 3100) | 0.010 |
| 82 | KNITCCDTD (SEQ ID NO: 3101) | 0.010 |

TABLE XVIII

V4-HLA-B7-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 32 | LPPSLRCSL (SEQ ID NO: 3102) | 120.000 |
| 160 | FPAHPIYDL (SEQ ID NO: 3103) | 120.000 |
| 66 | VPQASVPLL (SEQ ID NO: 3104) | 80.000 |
| 76 | HPAQWEPVL (SEQ ID NO: 3105) | 80.000 |
| 65 | VVPQASVPL (SEQ ID NO: 3106) | 20.000 |

TABLE XVIII-continued

V4-HLA-B7-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 57 | APLQPTLGV (SEQ ID NO: 3107) | 18.000 |
| 24 | AGPMPCSRL (SEQ ID NO: 3108) | 18.000 |
| 114 | TPTRQIGSI (SEQ ID NO: 3109) | 8.000 |
| 111 | LSRTPTRQI (SEQ ID NO: 3110) | 6.000 |
| 8 | WARRTSRAV (SEQ ID NO: 3111) | 6.000 |
| 163 | HPIYDLSQV (SEQ ID NO: 3112) | 4.000 |
| 146 | TLNPVLRHL (SEQ ID NO: 3113) | 4.000 |
| 51 | SYRLWGAPL (SEQ ID NO: 3114) | 4.000 |
| 55 | WGAPLQPTL (SEQ ID NO: 3115) | 4.000 |
| 130 | GPSNPLCCC (SEQ ID NO: 3116) | 3.000 |
| 176 | SPAPSRGQA (SEQ ID NO: 3117) | 3.000 |
| 102 | VPHPDPPMA (SEQ ID NO: 3118) | 2.000 |
| 106 | DPPMALSRT (SEQ ID NO: 3119) | 2.000 |
| 19 | TCATPAGPM (SEQ ID NO: 3120) | 1.500 |
| 177 | PAPSRGQAL (SEQ ID NO: 3121) | 1.200 |
| 46 | SGDPASYRL (SEQ ID NO: 3122) | 1.200 |
| 143 | AFSTLNPVL (SEQ ID NO: 3123) | 1.200 |
| 12 | TSRAVTPTC (SEQ ID NO: 3124) | 1.000 |
| 35 | SLRCSLHSA (SEQ ID NO: 3125) | 1.000 |
| 101 | PVPHPDPPM (SEQ ID NO: 3126) | 0.750 |
| 25 | GPMPCSRLP (SEQ ID NO: 3127) | 0.600 |
| 22 | TPAGPMPCS (SEQ ID NO: 3128) | 0.600 |
| 94 | LTMYVCAPV (SEQ ID NO: 3129) | 0.600 |
| 178 | APSRGQALR (SEQ ID NO: 3130) | 0.600 |
| 100 | APVPHPDPP (SEQ ID NO: 3131) | 0.600 |
| 127 | PADGPSNPL (SEQ ID NO: 3132) | 0.540 |
| 84 | LVPEAHPNA (SEQ ID NO: 3133) | 0.500 |
| 170 | QVWSVVSPA (SEQ ID NO: 3134) | 0.500 |
| 70 | SVPLLTHPA (SEQ ID NO: 3135) | 0.500 |
| 9 | ARRTSRAVT (SEQ ID NO: 3136) | 0.450 |
| 14 | RAVTPTCAT (SEQ ID NO: 3137) | 0.450 |
| 28 | PCSRLPPSL (SEQ ID NO: 3138) | 0.400 |
| 89 | HPNASLTMY (SEQ ID NO: 3139) | 0.400 |
| 125 | DPPADGPSN (SEQ ID NO: 3140) | 0.400 |

TABLE XVIII-continued

V4-HLA-B7-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 27 | MPCSRLPPS (SEQ ID NO: 3141) | 0.400 |
| 139 | FHGPAFSTL (SEQ ID NO: 3142) | 0.400 |
| 88 | AHPNASLTM (SEQ ID NO: 3143) | 0.300 |
| 42 | SACCSGDPA (SEQ ID NO: 3144) | 0.300 |
| 48 | DPASYRLWG (SEQ ID NO: 3145) | 0.300 |
| 21 | ATPAGPMPC (SEQ ID NO: 3146) | 0.300 |
| 63 | LGVVPQASV (SEQ ID NO: 3147) | 0.300 |
| 92 | ASLTMYVCA (SEQ ID NO: 3148) | 0.300 |
| 87 | EAHPNASLT (SEQ ID NO: 3149) | 0.300 |
| 91 | NASLTMYVC (SEQ ID NO: 3150) | 0.300 |
| 148 | NPVLRHLFP (SEQ ID NO: 3151) | 0.200 |
| 167 | DLSQVWSVV (SEQ ID NO: 3152) | 0.200 |
| 81 | EPVLVPEAH (SEQ ID NO: 3153) | 0.002 |
| 60 | QPTLGVVPQ (SEQ ID NO: 3154) | 0.200 |
| 133 | NPLCCCFHG (SEQ ID NO: 3155) | 0.200 |
| 155 | FPQEAFPAH (SEQ ID NO: 3156) | 0.200 |
| 17 | TPTCATPAG (SEQ ID NO: 3157) | 0.200 |

TABLE XVIII-continued

V4-HLA-B7-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 71 | VPLLTHPAQ (SEQ ID NO: 3158) | 0.200 |
| 141 | GPAFSTLNP (SEQ ID NO: 3159) | 0.200 |
| 104 | HPDPPMALS (SEQ ID NO: 3160) | 0.180 |
| 29 | CSRLPPSLR (SEQ ID NO: 3161) | 0.150 |
| 15 | AVTPTCATP (SEQ ID NO: 3162) | 0.150 |
| 85 | VPEAHPNAS (SEQ ID NO: 3163) | 0.120 |
| 11 | RTSRAVTPT (SEQ ID NO: 3164) | 0.100 |
| 129 | DGPSNPLCC (SEQ ID NO: 3165) | 0.100 |
| 16 | VTPTCATPA (SEQ ID NO: 3166) | 0.100 |
| 120 | GSIDTDPPA (SEQ ID NO: 3167) | 0.100 |
| 4 | RTTTWARRT (SEQ ID NO: 3168) | 0.100 |
| 150 | VLRHLFPQE (SEQ ID NO: 3169) | 0.100 |
| 37 | RCSLHSACC (SEQ ID NO: 3170) | 0.100 |
| 135 | LCCCFHGPA (SEQ ID NO: 3171) | 0.100 |
| 1 | MTHR1TVWA (SEQ ID NO: 3172) | 0.100 |
| 173 | SVVSPAPSR (SEQ ID NO: 3173) | 0.075 |
| 97 | YVCAPVPHP (SEQ ID NO: 3174) | 0.075 |

TABLE XVIII-continued

V4-HLA-B7-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 43 | ACCSGDPAS (SEQ ID NO: 3175) | 0.060 |
| 158 | EAFPAHPIY (SEQ ID NO: 3176) | 0.060 |
| 86 | PEAHPNASL (SEQ ID NO: 3177) | 0.060 |
| 107 | PPMALSRTP (SEQ ID NO: 3178) | 0.060 |
| 103 | PHPDPPMAL (SEQ ID NO: 3179) | 0.060 |
| 77 | PAQWEPVLV (SEQ ID NO: 3180) | 0.060 |
| 142 | PAFSTLNPV (SEQ ID NO: 3181) | 0.060 |
| 157 | QEAFPAHPI (SEQ ID NO: 3182) | 0.060 |
| 174 | VVSPAPSRG (SEQ ID NO: 3183) | 0.050 |
| 64 | GVVPQASVP (SEQ ID NO: 3184) | 0.050 |
| 99 | CAPVPHPDP (SEQ ID NO: 3185) | 0.045 |
| 78 | AQWEPVLVP (SEQ ID NO: 3186) | 0.045 |
| 68 | QASVPLLTH (SEQ ID NO: 3187) | 0.045 |
| 50 | ASYRLWGAP (SEQ ID NO: 3188) | 0.030 |
| 128 | ADGPSNPLC (SEQ ID NO: 3189) | 0.030 |
| 56 | GAPLQPTLG (SEQ ID NO: 3190) | 0.030 |
| 109 | MALSRTPTR (SEQ ID NO: 3191) | 0.030 |

TABLE XVIII-continued

V4-HLA-B7-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 49 | PASYRLWGA (SEQ ID NO: 3192) | 0.030 |
| 69 | ASVPLLTHP (SEQ ID NO: 3193) | 0.030 |
| 5 | TTTWARRTS (SEQ ID NO: 3194) | 0.030 |
| 20 | CATPAGPMP (SEQ ID NO: 3195) | 0.030 |
| 110 | ALSRTPTRQ (SEQ ID NO: 3196) | 0.030 |
| 147 | LNPVLRHLF (SEQ ID NO: 3197) | 0.030 |
| 137 | CCFHGPAFS (SEQ ID NO: 3198) | 0.020 |
| 58 | PLQPTLGVV (SEQ ID NO: 3199) | 0.020 |
| 126 | PPADGPSNP (SEQ ID NO: 3200) | 0.020 |
| 31 | RLPPSLRCS (SEQ ID NO: 3201) | 0.020 |

TABLE XVIII

V19-HLA-B7-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 1 | GPMPCSRLL (SEQ ID NO: 3202) | 240.000 |
| 8 | LLPSLRCSL (SEQ ID NO: 3203) | 6.000 |
| 3 | MPCSRLLPS (SEQ ID NO: 3204) | 0.400 |
| 4 | PCSRLLPSL (SEQ ID NO: 3205) | 0.400 |

TABLE XVIII-continued

V19-HLA-B7-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 9 | LPSLRCSLH (SEQ ID NO: 3206) | 0.200 |
| 5 | CSRLLPSLR (SEQ ID NO: 3207) | 0.100 |
| 7 | RLLPSLRCS (SEQ ID NO: 3208) | 0.020 |
| 6 | SRLLPSLRC (SEQ ID NO: 3209) | 0.015 |
| 2 | PMPCSRLLP (SEQ ID NO: 3210) | 0.002 |

TABLE XVIII

V20-HLA-B7-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 8 | SSRLWGAPL (SEQ ID NO: 3211) | 40.000 |
| 3 | SGDPASSRL (SEQ ID NO: 3212) | 1.200 |
| 5 | DPASSRLWG (SEQ ID NO: 3213) | 0.300 |
| 6 | PASSRLWGA (SEQ ID NO: 3214) | 0.030 |
| 7 | ASSRLWGAP (SEQ ID NO: 3215) | 0.030 |
| 1 | CCSGDPASS (SEQ ID NO: 3216) | 0.020 |
| 2 | CSGDPASSR (SEQ ID NO: 3217) | 0.015 |
| 4 | GDPASSRLW (SEQ ID NO: 3218) | 0.002 |
| 9 | SRLWGAPLQ (SEQ ID NO: 3219) | 0.001 |

TABLE XVIII

V21-HLA-B7-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 9 | DPAQWEPVL (SEQ ID NO: 3220) | 80.000 |
| 3 | SVPLLTDPA (SEQ ID NO: 3221) | 0.500 |
| 4 | VPLLTDPAQ (SEQ ID NO: 3222) | 0.200 |
| 1 | QASVPLLTD (SEQ ID NO: 3223) | 0.045 |
| 2 | ASVPLLTDP (SEQ ID NO: 3224) | 0.030 |
| 8 | TDPAQWEPV (SEQ ID NO: 3225) | 0.020 |
| 6 | LLTDPAQWE (SEQ ID NO: 3226) | 0.015 |
| 7 | LTDPAQWEP (SEQ ID NO: 3227) | 0.003 |
| 5 | PLLTDPAQW (SEQ ID NO: 3228) | 0.002 |

TABLE XVIII

V21&22-HLA-B7-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 1 | ASVPLLTDL (SEQ ID NO: 3229) | 12.000 |
| 8 | DLAQWEPVL (SEQ ID NO: 3230) | 4.000 |
| 2 | SVPLLTDLA (SEQ ID NO: 3231) | 0.500 |
| 3 | VPLLTDLAQ (SEQ ID NO: 3232) | 0.200 |
| 7 | TDLAQWEPV (SEQ ID NO: 3233) | 0.020 |

TABLE XVIII-continued

V21&22-HLA-B7-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 5 | LLTDLAQWE (SEQ ID NO: 3234) | 0.010 |
| 6 | LTDLAQWEP (SEQ ID NO: 3235) | 0.003 |
| 4 | PLLTDLAQW (SEQ ID NO: 3236) | 0.002 |

TABLE XVIII

V22-HLA-B7-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 1 | ASVPLLTHL (SEQ ID NO: 3237) | 12.000 |
| 8 | HLAQWEPVL (SEQ ID NO: 3238) | 4.000 |
| 9 | LAQWEPVLV (SEQ ID NO: 3239) | 0.600 |
| 2 | SVPLLTHLA (SEQ ID NO: 3240) | 0.500 |
| 3 | VPLLTHLAQ (SEQ ID NO: 3241) | 0.200 |
| 7 | THLAQWEPV (SEQ ID NO: 3242) | 0.020 |
| 6 | LTHLAQWEP (SEQ ID NO: 3243) | 0.010 |
| 5 | LLTHLAQWE (SEQ ID NO: 3244) | 0.010 |
| 4 | PLLTHLAQW (SEQ ID NO: 3245) | 0.002 |

TABLE XVIII

V24-HLA-B7-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 3 | LTMYVCTPV (SEQ ID NO: 3246) | 0.600 |
| 1 | ASLTMYVCT (SEQ ID NO: 3247) | 0.300 |
| 6 | YVCTPVPHP (SEQ ID NO: 3248) | 0.075 |
| 8 | CTPVPHPDP (SEQ ID NO: 3249) | 0.015 |
| 4 | TMYVCTPVP (SEQ ID NO: 3250) | 0.010 |
| 7 | VCTPVPHPD (SEQ ID NO: 3251) | 0.010 |
| 2 | SLTMYVCTP (SEQ ID NO: 3252) | 0.010 |
| 5 | MYVCTPVPH (SEQ ID NO: 3253) | 0.001 |

TABLE XVIII

V25-HLA-B7-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 3 | TPTRQISSI (SEQ ID NO: 3254) | 8.000 |
| 9 | SSIDTDPPA (SEQ ID NO: 3255) | 0.100 |
| 2 | RTPTRQISS (SEQ ID NO: 3256) | 0.020 |
| 8 | ISSIDTDPP (SEQ ID NO: 3257) | 0.010 |
| 7 | QISSIDTDP (SEQ ID NO: 3258) | 0.010 |

TABLE XVIII-continued

V25-HLA-B7-9MERS-PSCA
Each peptide is a portion of SEQ ID
NO: 8; each start position is
specified, the length of peptide is 9
amino acids, and the end position
for each peptide is the start position
plus eight.

| START | SUBSEQUENCE | SCORE |
|---|---|---|
| 4 | PTRQISSID (SEQ ID NO: 3259) | 0.010 |
| 6 | RQISSIDTD (SEQ ID NO: 3260) | 0.010 |
| 5 | TRQISSIDT (SEQ ID NO: 3261) | 0.010 |
| 1 | SRTPTRQIS (SEQ ID NO: 3262) | 0.003 |

TABLE XVIII

V25&26-HLA-B7-9MERS-PSCA
Each peptide is a portion of SEQ ID
NO: 8; each start position is
specified, the length of peptide is 9
amino acids, and the end position
for each peptide is the start position
plus eight.

| START | SUBSEQUENCE | SCORE |
|---|---|---|
| 1 | TPTRQISSS (SEQ ID NO: 3263) | 0.400 |
| 7 | SSSDTDPPA (SEQ ID NO: 3264) | 0.100 |
| 5 | QISSSDTDP (SEQ ID NO: 3265) | 0.010 |
| 6 | ISSSDTDPP (SEQ ID NO: 3266) | 0.010 |
| 3 | TRQISSSDT (SEQ ID NO: 3267) | 0.010 |
| 2 | PTRQISSSD (SEQ ID NO: 3268) | 0.010 |
| 4 | RQISSSDTD (SEQ ID NO: 3269) | 0.010 |

TABLE XVIII

V26-HLA-B7-9MERS-PSCA
Each peptide is a portion of SEQ ID
NO: 8; each start position is
specified, the length of peptide is 9
amino acids, and the end position
for each peptide is the start position
plus eight.

| START | SUBSEQUENCE | SCORE |
|---|---|---|
| 1 | TPTRQIGSS (SEQ ID NO: 3270) | 0.400 |
| 7 | GSSDTDPPA (SEQ ID NO: 3271) | 0.100 |
| 5 | QIGSSDTDP (SEQ ID NO: 3272) | 0.010 |
| 6 | IGSSDTDPP (SEQ ID NO: 3273) | 0.010 |
| 4 | RQIGSSDTD (SEQ ID NO: 3274) | 0.010 |
| 3 | TRQIGSSDT (SEQ ID NO: 3275) | 0.010 |
| 2 | PTRQIGSSD (SEQ ID NO: 3276) | 0.010 |
| 8 | SSDTDPPAD (SEQ ID NO: 3277) | 0.003 |
| 9 | SDTDPPADG (SEQ ID NO: 3278) | 0.002 |

TABLE XVIII

V27-HLA-B7-9MERS-PSCA
Each peptide is a portion of SEQ ID
NO: 8; each start position is specified,
the length of peptide is 9 amino acids,
and the end position for each peptide
is the start position plus eight.

| START | SUBSEQUENCE | SCORE |
|---|---|---|
| 2 | RGQALRRAQ (SEQ ID NO: 3279) | 0.015 |
| 1 | SRGQALRRA (SEQ ID NO: 3280) | 0.010 |

TABLE XIX

V1-HLA-B7-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 50 | TARIRAVGLL (SEQ ID NO: 3281) | 120.000 |
| 101 | QPAAAILALL (SEQ ID NO: 3282) | 80.000 |
| 104 | AAILALLPAL (SEQ ID NO: 3283) | 36.000 |
| 108 | ALLPALGLLL (SEQ ID NO: 3284) | 12.000 |
| 107 | LALLPALGLL (SEQ ID NO: 3285) | 12.000 |
| 98 | HALQPAAAIL (SEQ ID NO: 3286) | 12.000 |
| 6 | LALLMAGLAL (SEQ ID NO: 3287) | 12.000 |
| 27 | KAQVSNEDCL (SEQ ID NO: 3288) | 12.000 |
| 13 | LALQPGTALL (SEQ ID NO: 3289) | 12.000 |
| 106 | ILALLPALGL (SEQ ID NO: 3290) | 6.000 |
| 12 | GLALQPGTAL (SEQ ID NO: 3291) | 6.000 |
| 35 | CLQVENCTQL (SEQ ID NO: 3292) | 4.000 |
| 59 | LTVISKGCSL (SEQ ID NO: 3293) | 4.000 |
| 91 | LCNASGAHAL (SEQ ID NO: 3294) | 4.000 |
| 114 | GLLLWGPGQL (SEQ ID NO: 3295) | 4.000 |
| 100 | LQPAAAILAL (SEQ ID NO: 3296) | 4.000 |
| 49 | WTARIRAVGL (SEQ ID NO: 3297) | 4.000 |
| 4 | VLLALLMAGL (SEQ ID NO: 3298) | 4.000 |
| 82 | KNITCCDTDL (SEQ ID NO: 3299) | 4.000 |
| 52 | RIRAVGLLTV (SEQ ID NO: 3300) | 2.000 |
| 29 | QVSNEDCLQV (SEQ ID NO: 3301) | 1.000 |
| 103 | AAAILALLPA (SEQ ID NO: 3302) | 0.900 |
| 78 | YVGKKNITCC (SEQ ID NO: 3303) | 0.500 |
| 16 | QPGTALLCYS (SEQ ID NO: 3304) | 0.400 |
| 70 | CVDDSQDYYV (SEQ ID NO: 3305) | 0.300 |
| 11 | AGLALQPGTA (SEQ ID NO: 3306) | 0.300 |
| 99 | ALQPAAAILA (SEQ ID NO: 3307) | 0.300 |
| 10 | MAGLALQPGT (SEQ ID NO: 3308) | 0.300 |
| 96 | GAHALQPAAA (SEQ ID NO: 3309) | 0.300 |
| 94 | ASGAHALQPA (SEQ ID NO: 3310) | 0.300 |
| 2 | KAVLLALLMA (SEQ ID NO: 3311) | 0.300 |
| 19 | TALLCYSCKA (SEQ ID NO: 3312) | 0.300 |
| 14 | ALQPGTALLC (SEQ ID NO: 3313) | 0.300 |
| 62 | ISKGCSLNCV (SEQ ID NO: 3314) | 0.200 |

TABLE XIX-continued

V1-HLA-B7-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 110 | LPALGLLLWG (SEQ ID NO: 3315) | 0.200 |
| 21 | LLCYSCKAQV (SEQ ID NO: 3316) | 0.200 |
| 47 | QCWTARIRAV (SEQ ID NO: 3317) | 0.200 |
| 97 | AHALQPAAAI (SEQ ID NO: 3318) | 0.180 |
| 3 | AVLLALLMAG (SEQ ID NO: 3319) | 0.150 |
| 46 | EQCWTARIRA (SEQ ID NO: 3320) | 0.150 |
| 55 | AVGLLTVISK (SEQ ID NO: 3321) | 0.150 |
| 44 | LGEQCWTARI (SEQ ID NO: 3322) | 0.120 |
| 41 | CTQLGEQCWT (SEQ ID NO: 3323) | 0.100 |
| 60 | TVISKGCSLN (SEQ ID NO: 3324) | 0.100 |
| 57 | GLLTVISKGC (SEQ ID NO: 3325) | 0.100 |
| 61 | YISKGCSLNC (SEQ ID NO: 3326) | 0.100 |
| 5 | LLALLMAGLA (SEQ ID NO: 3327) | 0.100 |
| 90 | DLCNASGAHA (SEQ ID NO: 3328) | 0.100 |
| 42 | TQLGEQCWTA (SEQ ID NO: 3329) | 0.100 |
| 39 | ENCTQLGEQC (SEQ ID NO: 3330) | 0.100 |
| 1 | MKAVLLALLM (SEQ ID NO: 3331) | 0.100 |
| 95 | SGAHALQPAA (SEQ ID NO: 3332) | 0.100 |
| 83 | NITCCDTDLC (SEQ ID NO: 3333) | 0.100 |
| 85 | TCCDTDLCNA (SEQ ID NO: 3334) | 0.100 |
| 54 | RAVGLLTVIS (SEQ ID NO: 3335) | 0.060 |
| 75 | QDYYVGKKNI (SEQ ID NO: 3336) | 0.040 |
| 53 | IRAVGLLTVI (SEQ ID NO: 3337) | 0.040 |
| 51 | ARIRAVGLLT (SEQ ID NO: 3338) | 0.030 |
| 105 | AILALLPALG (SEQ ID NO: 3339) | 0.030 |
| 112 | ALGLLLWGPG (SEQ ID NO: 3340) | 0.030 |
| 8 | LLMAGLALQP (SEQ ID NO: 3341) | 0.030 |
| 28 | AQVSNEDCLQ (SEQ ID NO: 3342) | 0.030 |
| 93 | NASGAHALQP (SEQ ID NO: 3343) | 0.030 |
| 20 | ALLCYSCKAQ (SEQ ID NO: 3344) | 0.030 |
| 7 | ALLMAGLALQ (SEQ ID NO: 3345) | 0.030 |
| 88 | DTDLCNASGA (SEQ ID NO: 3346) | 0.030 |
| 69 | NCVDDSQDYY (SEQ ID NO: 3347) | 0.020 |
| 58 | LLTVISKGCS (SEQ ID NO: 3348) | 0.020 |

TABLE XIX-continued

V1-HLA-B7-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 65 | GCSLNCVDDS (SEQ ID NO: 3349) | 0.020 |
| 68 | LNCVDDSQDY (SEQ ID NO: 3350) | 0.020 |
| 40 | NCTQLGEQCW (SEQ ID NO: 3351) | 0.020 |
| 109 | LLPALGLLLW (SEQ ID NO: 3352) | 0.020 |
| 84 | ITCCDTDLCN (SEQ ID NO: 3353) | 0.020 |
| 22 | LCYSCKAQVS (SEQ ID NO: 3354) | 0.020 |
| 15 | LQPGTALLCY (SEQ ID NO: 3355) | 0.020 |
| 37 | QVENCTQLGE (SEQ ID NO: 3356) | 0.015 |
| 34 | DCLQVENCTQ (SEQ ID NO: 3357) | 0.010 |
| 33 | EDCLQVENCT (SEQ ID NO: 3358) | 0.010 |
| 25 | SCKAQVSNED (SEQ ID NO: 3359) | 0.010 |
| 79 | VGKKNITCCD (SEQ ID NO: 3360) | 0.010 |
| 64 | KGCSLNCVDD (SEQ ID NO: 3361) | 0.010 |
| 73 | DSQDYYVGKK (SEQ ID NO: 3362) | 0.010 |
| 26 | CKAQVSNEDC (SEQ ID NO: 3363) | 0.010 |
| 92 | CNASGAHALQ (SEQ ID NO: 3364) | 0.010 |
| 67 | SLNCVDDSQD (SEQ ID NO: 3365) | 0.010 |
| 80 | GKKNITCCDT (SEQ ID NO: 3366) | 0.010 |
| 66 | CSLNCVDDSQ (SEQ ID NO: 3367) | 0.010 |
| 76 | DYYVGKKNIL (SEQ ID NO: 3368) | 0.010 |
| 77 | YYVGKKNITC (SEQ ID NO: 3369) | 0.010 |
| 30 | VSNEDCLQVE (SEQ ID NO: 3370) | 0.010 |
| 24 | YSCKAQVSNE (SEQ ID NO: 3371) | 0.010 |
| 17 | PGTALLCYSC (SEQ ID NO: 3372) | 0.010 |
| 9 | LMAGLALQPG (SEQ ID NO: 3373) | 0.010 |
| 56 | VGLLTVISKG (SEQ ID NO: 3374) | 0.010 |
| 36 | LQVENCTQLG (SEQ ID NO: 3375) | 0.010 |
| 43 | QLGEQCWTAR (SEQ ID NO: 3376) | 0.010 |
| 113 | LGLLLWGPGQ (SEQ ID NO: 3377) | 0.010 |
| 18 | GTALLQYSCK (SEQ ID NO: 3378) | 0.010 |
| 86 | CCDTDLCNAS (SEQ ID NO: 3379) | 0.006 |
| 74 | SQDYYVGKKN (SEQ ID NO: 3380) | 0.006 |

TABLE XIX

V4-HLA-B7-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 102 | VPHPDPPMAL (SEQ ID NO: 3381) | 120.000 |
| 100 | APVPHPDPPM (SEQ ID NO: 3382) | 90.000 |
| 27 | MPCSRLPPSL (SEQ ID NO: 3383) | 80.000 |
| 176 | SPAPSRGQAL (SEQ ID NO: 3384) | 80.000 |
| 85 | VPEAHPNASL (SEQ ID NO: 3385) | 36.000 |
| 64 | GVVPQASVPL (SEQ ID NO: 3386) | 20.000 |
| 65 | VVPQASVPLL (SEQ ID NO: 3387) | 20.000 |
| 126 | PPADGPSNPL (SEQ ID NO: 3388) | 12.000 |
| 50 | ASYRLWGAPL (SEQ ID NO: 3389) | 12.000 |
| 57 | APLQPTLGVV (SEQ ID NO: 3390) | 12.000 |
| 31 | RLPPSLRCSL (SEQ ID NO: 3391) | 6.000 |
| 8 | WARRTSRAVT (SEQ ID NO: 3392) | 4.500 |
| 141 | GPAFSTLNPV (SEQ ID NO: 3393) | 4.000 |
| 89 | HPNASLTMYV (SEQ ID NO: 3394) | 4.000 |
| 45 | CSGDPASYRL (SEQ ID NO: 3395) | 4.000 |
| 76 | HPAQWEPVLV (SEQ ID NO: 3396) | 4.000 |
| 145 | STLNPVLRHL (SEQ ID NO: 3397) | 4.000 |

TABLE XIX-continued

V4-HLA-B7-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 87 | EAHPNASLTM (SEQ ID NO: 3398) | 3.000 |
| 60 | QPTLGVVPQA (SEQ ID NO: 3399) | 2.000 |
| 66 | VPQASVPLLT (SEQ ID NO: 3400) | 2.000 |
| 48 | DPASYRLWGA (SEQ ID NO: 3401) | 2.000 |
| 159 | AFPAHPIYDL (SEQ ID NO: 3402) | 1.800 |
| 23 | PAGPMPCSRL (SEQ ID NO: 3403) | 1.800 |
| 110 | ALSRTPTRQI (SEQ ID NO: 3404) | 1.800 |
| 15 | AVTPTCATPA (SEQ ID NO: 3405) | 1.500 |
| 29 | CSRLPPSLRC (SEQ ID NO: 3406) | 1.500 |
| 142 | PAFSTLNPVL (SEQ ID NO: 3407) | 1.200 |
| 35 | SLRCSLHSAC (SEQ ID NO: 3408) | 1.000 |
| 12 | TSRAVTPTCA (SEQ ID NO: 3409) | 1.000 |
| 150 | VLRHLFPQEA (SEQ ID NO: 3410) | 1.000 |
| 107 | PPMALSRTPT (SEQ ID NO: 3411) | 0.900 |
| 25 | GPMPCSRLPP (SEQ ID NO: 3412) | 0.900 |
| 56 | GAPLQPTLGV (SEQ ID NO: 3413) | 0.900 |
| 178 | APSRGQALRR (SEQ ID NO: 3414) | 0.600 |

TABLE XIX-continued

V4-HLA-B7-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 163 | HPIYDLSQVW (SEQ ID NO: 3415) | 0.400 |
| 113 | RTPTRQIGSI (SEQ ID NO: 3416) | 0.400 |
| 75 | THPAQWEPVL (SEQ ID NO: 3417) | 0.400 |
| 54 | LWGAPLQPTL (SEQ ID NO: 3418) | 0.400 |
| 130 | GPSNPLCCCF (SEQ ID NO: 3419) | 0.400 |
| 160 | FPAHPIYDLS (SEQ ID NO: 3420) | 0.400 |
| 138 | CFHGPAFSTL (SEQ ID NO: 3421) | 0.400 |
| 71 | VPLLTHPAQW (SEQ ID NO: 3422) | 0.400 |
| 81 | EPVLVPEAHP (SEQ ID NO: 3423) | 0.300 |
| 62 | TLGVVPQASV (SEQ ID NO: 3424) | 0.300 |
| 20 | CATPAGPMPC (SEQ ID NO: 3425) | 0.300 |
| 91 | NASLTMYVCA (SEQ ID NO: 3426) | 0.300 |
| 69 | ASVPLLTHPA (SEQ ID NO: 3427) | 0.300 |
| 125 | DPPADGPSNP (SEQ ID NO: 3428) | 0.200 |
| 32 | LPPSLRCSLH (SEQ ID NO: 3429) | 0.200 |
| 22 | TPAGPMPCSR (SEQ ID NO: 3430) | 0.200 |
| 148 | NPVLRHLFPQ (SEQ ID NO: 3431) | 0.200 |
| 106 | DPPMALSRTP (SEQ ID NO: 3432) | 0.200 |
| 155 | FPQEAFPAHP (SEQ ID NO: 3433) | 0.200 |
| 17 | TPTCATPAGP (SEQ ID NO: 3434) | 0.200 |
| 133 | NPLCCCFHGP (SEQ ID NO: 3435) | 0.200 |
| 93 | SLTMYVCAPV (SEQ ID NO: 3436) | 0.200 |
| 114 | TPTRQIGSID (SEQ ID NO: 3437) | 0.200 |
| 74 | LTHPAQWEPV (SEQ ID NO: 3438) | 0.200 |
| 53 | RLWGAPLQPT (SEQ ID NO: 3439) | 0.150 |
| 111 | LSRTPTRQIG (SEQ ID NO: 3440) | 0.150 |
| 137 | CGFHGPAFST (SEQ ID NO: 3441) | 0.150 |
| 129 | DGPSNPLCCC (SEQ ID NO: 3442) | 0.150 |
| 175 | VSPAPSRGQA (SEQ ID NO: 3443) | 0.150 |
| 18 | PTCATPAGPM (SEQ ID NO: 3444) | 0.150 |
| 179 | PSRGQALRRA (SEQ ID NO: 3445) | 0.100 |
| 153 | HLFPQEAFPA (SEQ ID NO: 3446) | 0.100 |
| 11 | RTSRAVTPTC (SEQ ID NO: 3447) | 0.100 |
| 6 | TTWARRTSRA (SEQ ID NO: 3448) | 0.100 |

TABLE XIX-continued

V4-HLA-B7-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 83 | VLVPEAHPNA (SEQ ID NO: 3449) | 0.100 |
| 119 | IGSIDTDPPA (SEQ ID NO: 3450) | 0.100 |
| 84 | LVPEAHPNAS (SEQ ID NO: 3451) | 0.100 |
| 169 | SQVWSVVSPA (SEQ ID NO: 3452) | 0.100 |
| 115 | PTRQIGSIDT (SEQ ID NO: 3453) | 0.100 |
| 41 | HSACCSGDPA (SEQ ID NO: 3454) | 0.100 |
| 21 | ATPAGPMPCS (SEQ ID NO: 3455) | 0.090 |
| 174 | VVSPAPSRGQ (SEQ ID NO: 3456) | 0.075 |
| 104 | HPDPPMALSR (SEQ ID NO: 3457) | 0.060 |
| 162 | AHPIYDLSQV (SEQ ID NO: 3458) | 0.060 |
| 42 | SACCSGDPAS (SEQ ID NO: 3459) | 0.060 |
| 43 | ACCSGDPASY (SEQ ID NO: 3460) | 0.060 |
| 101 | PVPHPDPPMA (SEQ ID NO: 3461) | 0.050 |
| 70 | SVPLLTHPAQ (SEQ ID NO: 3462) | 0.050 |
| 173 | SVVSPAPSRG (SEQ ID NO: 3463) | 0.050 |
| 97 | YVCAPVPHPD (SEQ ID NO: 3464) | 0.050 |
| 170 | QVWSVVSPAP (SEQ ID NO: 3465) | 0.050 |
| 33 | PPSLRCSLHS (SEQ ID NO: 3466) | 0.040 |
| 24 | AGPMPCSRLP (SEQ ID NO: 3467) | 0.030 |
| 146 | TLNPVLRHLF (SEQ ID NO: 3468) | 0.030 |
| 94 | LTMYVCAPVP (SEQ ID NO: 3469) | 0.030 |
| 92 | ASLTMYVCAP (SEQ ID NO: 3470) | 0.030 |
| 128 | ADGPSNPLCC (SEQ ID NO: 3471) | 0.030 |
| 68 | QASVPLLTHP (SEQ ID NO: 3472) | 0.030 |
| 9 | ARRTSRAVTP (SEQ ID NO: 3473) | 0.030 |
| 78 | AQWEPVLVPE (SEQ ID NO: 3474) | 0.030 |
| 14 | RAVTPTCATP (SEQ ID NO: 3475) | 0.030 |
| 99 | CAPVPHPDPP (SEQ ID NO: 3476) | 0.030 |
| 109 | MALSRTPTRQ (SEQ ID NO: 3477) | 0.030 |
| 4 | RTTTWARRTS (SEQ ID NO: 3478) | 0.030 |
| 158 | EAFPAHPIYD (SEQ ID NO: 3479) | 0.030 |
| 166 | YDLSQVWSVV (SEQ ID NO: 3480) | 0.020 |

TABLE XIX

V19-HLA-B7-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 4 | MPCSRLLPSL (SEQ ID NO: 3481) | 80.000 |
| 1 | AGPMPCSRLL (SEQ ID NO: 3482) | 12.000 |
| 8 | RLLPSLRCSL (SEQ ID NO: 3483) | 6.000 |
| 6 | CSRLLPSLRC (SEQ ID NO: 3484) | 1.500 |
| 2 | GPMPCSRLLP (SEQ ID NO: 3485) | 0.900 |
| 10 | LPSLRCSLHS (SEQ ID NO: 3486) | 0.400 |
| 9 | LLPSLRCSLH (SEQ ID NO: 3487) | 0.010 |
| 3 | PMPCSRLLPS (SEQ ID NO: 3488) | 0.002 |
| 7 | SRLLPSLRCS (SEQ ID NO: 3489) | 0.002 |
| 5 | PCSRLLPSLR (SEQ ID NO: 3490) | 0.001 |

TABLE XIX

V20-HLA-B7-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 8 | ASSRLWGAPL (SEQ ID NO: 3491) | 12.000 |
| 3 | CSGDPASSRL (SEQ ID NO: 3492) | 4.000 |
| 6 | DPASSRLWGA (SEQ ID NO: 3493) | 2.000 |
| 9 | SSRLWGAPLQ (SEQ ID NO: 3494) | 0.100 |

TABLE XIX-continued

V20-HLA-B7-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 1 | ACCSGDPASS (SEQ ID NO: 3495) | 0.060 |
| 2 | CCSGDPASSR (SEQ ID NO: 3496) | 0.015 |
| 4 | SGDPASSRLW (SEQ ID NO: 3497) | 0.006 |
| 7 | PASSRLWGAP (SEQ ID NO: 3498) | 0.003 |
| 5 | GDPASSRLWG (SEQ ID NO: 3499) | 0.002 |
| 10 | SRLWGAPLQP (SEQ ID NO: 3500) | 0.001 |

TABLE XIX

V21-HLA-B7-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 10 | DPAQWEPVLV (SEQ ID NO: 3501) | 4.000 |
| 9 | TDPAQWEPVL (SEQ ID NO: 3502) | 0.400 |
| 5 | VPLLTDPAQW (SEQ ID NO: 3503) | 0.400 |
| 3 | ASVPLLTDPA (SEQ ID NO: 3504) | 0.300 |
| 8 | LTDPAQWEPV (SEQ ID NO: 3505) | 0.060 |
| 4 | SVPLLTDPAQ (SEQ ID NO: 3506) | 0.050 |
| 2 | QASVPLLTDP (SEQ ID NO: 3507) | 0.030 |
| 7 | LLTDPAQWEP (SEQ ID NO: 3508) | 0.010 |

TABLE XIX-continued

V21-HLA-B7-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 6 | PLLTDPAQWE (SEQ ID NO: 3509) | 0.002 |
| 1 | PQASVPLLTD (SEQ ID NO: 3510) | 0.002 |

TABLE XIX

V21&22-HLA-B7-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 1 | QASVPLLTDL (SEQ ID NO: 3511) | 12.000 |
| 8 | TDLAQWEPVL (SEQ ID NO: 3512) | 0.400 |
| 4 | VPLLTDLAQW (SEQ ID NO: 3513) | 0.400 |
| 2 | ASVPLLTDLA (SEQ ID NO: 3514) | 0.300 |
| 9 | DLAQWEPVLV (SEQ ID NO: 3515) | 0.200 |
| 7 | LTDLAQWEPV (SEQ ID NO: 3516) | 0.060 |
| 3 | SVPLLTDLAQ (SEQ ID NO: 3517) | 0.050 |
| 6 | LLTDLAQWEP (SEQ ID NO: 3518) | 0.010 |
| 5 | PLLTDLAQWE (SEQ ID NO: 3519) | 0.001 |

TABLE XIX

V22-HLA-B7-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 1 | QASVPLLTHL (SEQ ID NO: 3520) | 12.000 |
| 8 | THLAQWEPVL (SEQ ID NO: 3521) | 0.400 |
| 4 | VPLLTHLAQW (SEQ ID NO: 3522) | 0.400 |
| 2 | ASVPLLTHLA (SEQ ID NO: 3523) | 0.300 |
| 7 | LTHLAQWEPV (SEQ ID NO: 3524) | 0.200 |
| 9 | HLAQWEPVLV (SEQ ID NO: 3525) | 0.200 |
| 3 | SVPLLTHLAQ (SEQ ID NO: 3526) | 0.050 |
| 10 | LAQWEPVLVP (SEQ ID NO: 3527) | 0.045 |
| 6 | LLTHLAQWEP (SEQ ID NO: 3528) | 0.010 |
| 5 | PLLTHLAQWE (SEQ ID NO: 3529) | 0.001 |

TABLE XIX

V24-HLA-B7-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 10 | TPVPHPDPPM (SEQ ID NO: 3530) | 30.000 |
| 1 | NASLTMYVCT (SEQ ID NO: 3531) | 0.300 |
| 3 | SLTMYVCTPV (SEQ ID NO: 3532) | 0.200 |
| 7 | YVCTPVPHPD (SEQ ID NO: 3533) | 0.050 |

TABLE XIX-continued

V24-HLA-B7-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 2 | ASLTMYVCTP (SEQ ID NO: 3534) | 0.030 |
| 4 | LTMYVCTPVP (SEQ ID NO: 3535) | 0.030 |
| 8 | VCTPYPHPDP (SEQ ID NO: 3536) | 0.015 |
| 9 | CTPVPHPDPP (SEQ ID NO: 3537) | 0.010 |
| 5 | TMYVCTPVPH (SEQ ID NO: 3538) | 0.010 |
| 6 | MYVCTPVPHP (SEQ ID NO: 3539) | 0.002 |

TABLE XIX

V25-HLA-B7-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 3 | RTPTRQISSI (SEQ ID NO: 3540) | 0.400 |
| 1 | LSRTPTRQIS (SEQ ID NO: 3541) | 0.300 |
| 4 | TPTRQISSID (SEQ ID NO: 3542) | 0.200 |
| 9 | ISSIDTDPPA (SEQ ID NO: 3543) | 0.100 |
| 5 | PTRQISSIDT (SEQ ID NO: 3544) | 0.100 |
| 10 | SSIDTDPPAD (SEQ ID NO: 3545) | 0.010 |
| 7 | RQISSIDTDP (SEQ ID NO: 3546) | 0.010 |
| 8 | QISSIDTDPP (SEQ ID NO: 3547) | 0.010 |

TABLE XIX-continued

V25-HLA-B7-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 2 | SRTPTRQISS (SEQ ID NO: 3548) | 0.002 |
| 6 | TRQISSIDTD (SEQ ID NO: 3549) | 0.001 |

TABLE XIX

V25&26-HLA-B7-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 2 | TPTRQISSSD (SEQ ID NO: 3550) | 0.200 |
| 7 | ISSSDTDPPA (SEQ ID NO: 3551) | 0.100 |
| 3 | PTRQISSSDT (SEQ ID NO: 3552) | 0.100 |
| 1 | RTPTRQISSS (SEQ ID NO: 3553) | 0.020 |
| 8 | SSSDTDPPAD (SEQ ID NO: 3554) | 0.010 |
| 6 | QISSSDTDPP (SEQ ID NO: 3555) | 0.010 |
| 5 | RQISSSDTDP (SEQ ID NO: 3556) | 0.010 |
| 4 | TRQISSSDTD (SEQ ID NO: 3557) | 0.001 |

TABLE XIX

V26-HLA-B7-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 2 | TPTRQIGSSD (SEQ ID NO: 3558) | 0.200 |

TABLE XIX-continued

V26-HLA-B7-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 3 | PTRQIGSSDT (SEQ ID NO: 3559) | 0.100 |
| 7 | IGSSDTDPPA (SEQ ID NO: 3560) | 0.100 |
| 1 | RTPTRQIGSS (SEQ ID NO: 3561) | 0.020 |
| 8 | GSSDTDPPAD (SEQ ID NO: 3562) | 0.010 |
| 6 | QIGSSDTDPP (SEQ ID NO: 3563) | 0.010 |
| 5 | RQIGSSDTDP (SEQ ID NO: 3564) | 0.010 |
| 9 | SSDTDPPADG (SEQ ID NO: 3565) | 0.004 |
| 10 | SDTDPPADGP (SEQ ID NO: 3566) | 0.002 |
| 4 | TRQIGSSDTD (SEQ ID NO: 3567) | 0.001 |

TABLE XIX

V27-HLA-B7-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 1 | PSRGQALRRA (SEQ ID NO: 3568) | 0.100 |
| 2 | SRGQALRRAQ (SEQ ID NO: 3569) | 0.002 |

TABLE XX

V1-HLA-B3501-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 16 | QPGTALLCY (SEQ ID NO: 3570) | 40.000 |
| 101 | QPAAAILAL (SEQ ID NO: 3571) | 20.000 |
| 2 | KAVLLALLM (SEQ ID NO: 3572) | 12.000 |
| 110 | LPALGLLLW (SEQ ID NO: 3573) | 10.000 |
| 50 | TARIRAVGL (SEQ ID NO: 3574) | 9.000 |
| 69 | NCVDDSQDY (SEQ ID NO: 3575) | 6.000 |
| 107 | LALLPALGL (SEQ ID NO: 3576) | 3.000 |
| 30 | VSNEDCLQV (SEQ ID NO: 3577) | 3.000 |
| 13 | LALQPGTAL (SEQ ID NO: 3578) | 3.000 |
| 54 | RAVGLLTVI (SEQ ID NO: 3579) | 2.400 |
| 36 | LQVENCTQL (SEQ ID NO: 3580) | 2.000 |
| 62 | ISKGCSLNC (SEQ ID NO: 3581) | 1.500 |
| 70 | CVDDSQDYY (SEQ ID NO: 3582) | 1.200 |
| 98 | HALQRAAAI (SEQ ID NO: 3583) | 1.200 |
| 60 | TVISKGCSL (SEQ ID NO: 3584) | 1.000 |
| 99 | ALQPAAAIL (SEQ ID NO: 3585) | 1.000 |
| 108 | ALLPALGLL (SEQ ID NO: 3586) | 1.000 |

TABLE XX-continued

V1-HLA-B3501-9MERS-PSCA
Each peptide is a portion of SEQ ID NO: 2;
each start position is specified, the
length of peptide is 9 amino acids, and
the end position for each peptide is the
start position plus eight.

| START | SUBSEQUENCE | SCORE |
|---|---|---|
| 105 | AILALLPAL (SEQ ID NO: 3587) | 1.000 |
| 115 | LLLWGPGQL (SEQ ID NO: 3588) | 1.000 |
| 83 | NITCCDTDL (SEQ ID NO: 3589) | 1.000 |
| 14 | ALQPGTALL (SEQ ID NO: 3590) | 1.000 |
| 28 | AQVSNEDCL (SEQ ID NO: 3591) | 1.000 |
| 92 | CNASGAHAL (SEQ ID NO: 3592) | 1.000 |
| 5 | LLALLMAGL (SEQ ID NO: 3593) | 1.000 |
| 109 | LLPALGLLL (SEQ ID NO: 3594) | 1.000 |
| 7 | ALLMAGLAL (SEQ ID NO: 3595) | 1.000 |
| 52 | RIRAVGLLT (SEQ ID NO: 3596) | 0.600 |
| 27 | KAQVSNEDC (SEQ ID NO: 3597) | 0.600 |
| 24 | YSCKAQVSN (SEQ ID NO: 3598) | 0.500 |
| 41 | CTQLGEQCW (SEQ ID NO: 3599) | 0.500 |
| 66 | CSLNCVDDS (SEQ ID NO: 3600) | 0.500 |
| 79 | VGKKNITCC (SEQ ID NO: 3601) | 0.300 |
| 104 | AAILALLPA (SEQ ID NO: 3602) | 0.300 |
| 102 | PAAAILALL (SEQ ID NO: 3603) | 0.300 |

TABLE XX-continued

V1-HLA-B3501-9MERS-PSCA
Each peptide is a portion of SEQ ID NO: 2;
each start position is specified, the
length of peptide is 9 amino acids, and
the end position for each peptide is the
start position plus eight.

| START | SUBSEQUENCE | SCORE |
|---|---|---|
| 96 | GAHALQPAA (SEQ ID NO: 3604) | 0.300 |
| 6 | LALLMAGLA (SEQ ID NO: 3605) | 0.300 |
| 85 | TCCDTDLCN (SEQ ID NO: 3606) | 0.200 |
| 43 | QLGEQCWTA (SEQ ID NO: 3607) | 0.200 |
| 22 | LCYSCKAQV (SEQ ID NO: 3608) | 0.200 |
| 42 | TQLGEQCWT (SEQ ID NO: 3609) | 0.150 |
| 84 | ITCCDTDLC (SEQ ID NO: 3610) | 0.150 |
| 100 | LQPAAAILA (SEQ ID NO: 3611) | 0.100 |
| 59 | LTVISKGCS (SEQ ID NO: 3612) | 0.100 |
| 78 | YVGKKNITC (SEQ ID NO: 3613) | 0.100 |
| 12 | GLALQPGTA (SEQ ID NO: 3614) | 0.100 |
| 73 | DSQDYYVGK (SEQ ID NO: 3615) | 0.100 |
| 47 | QCWTARIRA (SEQ ID NO: 3616) | 0.100 |
| 18 | GTALLCYSC (SEQ ID NO: 3617) | 0.100 |
| 61 | VISKGCSLN (SEQ ID NO: 3618) | 0.100 |
| 15 | LQPGTALLC (SEQ ID NO: 3619) | 0.100 |
| 55 | AVGLLTVIS (SEQ ID NO: 3620) | 0.100 |

TABLE XX-continued

V1-HLA-B3501-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 3 | AVLLALLMA (SEQ ID NO: 3621) | 0.100 |
| 1 | MKAVLLALL (SEQ ID NO: 3622) | 0.100 |
| 51 | ARIRAVGLL (SEQ ID NO: 3623) | 0.100 |
| 95 | SGAHALQPA (SEQ ID NO: 3624) | 0.100 |
| 91 | LCNASGAHA (SEQ ID NO: 3625) | 0.100 |
| 20 | ALLCYSCKA (SEQ ID NO: 3626) | 0.100 |
| 58 | LLTVISKGC (SEQ ID NO: 3627) | 0.100 |
| 34 | DCLQVENCT (SEQ ID NO: 3628) | 0.100 |
| 40 | NCTQLGEQC (SEQ ID NO: 3629) | 0.100 |
| 11 | AGLALQPGT (SEQ ID NO: 3630) | 0.100 |
| 94 | ASGAHALQP (SEQ ID NO: 3631) | 0.050 |
| 86 | CCDTDLCNA (SEQ ID NO: 3632) | 0.045 |
| 45 | GEQCWTARI (SEQ ID NO: 3633) | 0.040 |
| 76 | DYYVGKKNI (SEQ ID NO: 3634) | 0.040 |
| 25 | SCKAQVSNE (SEQ ID NO: 3635) | 0.030 |
| 19 | TALLCYSCK (SEQ ID NO: 3636) | 0.030 |
| 93 | NASGAHALQ (SEQ ID NO: 3637) | 0.030 |

TABLE XX-continued

V1-HLA-B3501-9MERS-PSCA
Each peptide is a portion of SEQ ID NO: 2; each start position is specified, the length of peptide is 9 amino acids, and the end position for each peptide is the start position plus eight.

| START | SUBSEQUENCE | SCORE |
|---|---|---|
| 103 | AAAILALLP (SEQ ID NO: 3638) | 0.030 |
| 10 | MAGLALQPG (SEQ ID NO: 3639) | 0.030 |
| 64 | KGCSLNCVD (SEQ ID NO: 3640) | 0.020 |
| 63 | SKGCSLNCV (SEQ ID NO: 3641) | 0.020 |
| 82 | KNITCCDTD (SEQ ID NO: 3642) | 0.020 |
| 87 | CDTDLCNAS (SEQ ID NO: 3643) | 0.020 |
| 53 | IRAVGLLTV (SEQ ID NO: 3644) | 0.020 |
| 81 | KKNITCCDT (SEQ ID NO: 3645) | 0.020 |
| 48 | CWTARIRAV (SEQ ID NO: 3646) | 0.020 |
| 29 | QVSNEDCLQ (SEQ ID NO: 3647) | 0.015 |
| 68 | LNCVDDSQD (SEQ ID NO: 3648) | 0.015 |
| 35 | CLQVENCTQ (SEQ ID NO: 3649) | 0.015 |
| 113 | LGLLLWGPG (SEQ ID NO: 3650) | 0.010 |
| 90 | DLCNASGAH (SEQ ID NO: 3651) | 0.010 |
| 114 | GLLLWGPGQ (SEQ ID NO: 3652) | 0.010 |
| 33 | EDCLQVENC (SEQ ID NO: 3653) | 0.010 |
| 21 | LLCYSCKAQ (SEQ ID NO: 3654) | 0.010 |

TABLE XX-continued

V1-HLA-B3501-9MERS-PSCA
Each peptide is a portion of SEQ ID NO: 2;
each start position is specified, the
length of peptide is 9 amino acids, and
the end position for each peptide is the
start position plus eight.

| START | SUBSEQUENCE | SCORE |
|---|---|---|
| 67 | SLNCVDDSQ (SEQ ID NO: 3655) | 0.010 |
| 57 | GLLTVISKG (SEQ ID NO: 3656) | 0.010 |
| 23 | CYSCKAQVS (SEQ ID NO: 3657) | 0.010 |
| 112 | ALGLLLWGP (SEQ ID NO: 3658) | 0.010 |
| 17 | PGTALLCYS (SEQ ID NO: 3659) | 0.010 |
| 56 | VGLLTVISK (SEQ ID NO: 3660) | 0.010 |
| 49 | WTARIRAVG (SEQ ID NO: 3661) | 0.010 |
| 9 | LMAGLALQP (SEQ ID NO: 3662) | 0.010 |
| 39 | ENCTQLGEQ (SEQ ID NO: 3663) | 0.010 |
| 65 | GCSLNCVDD (SEQ ID NO: 3664) | 0.010 |
| 97 | AHALQPAAA (SEQ ID NO: 3665) | 0.010 |
| 106 | ILALLPALG (SEQ ID NO: 3666) | 0.010 |
| 8 | LLMAGLALQ (SEQ ID NO: 3667) | 0.010 |
| 46 | EQCWTARIR (SEQ ID NO: 3668) | 0.010 |
| 89 | TDLCNASGA (SEQ ID NO: 3669) | 0.010 |

TABLE XX

V4-HLA-B3501-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 89 | HPNASLTMY (SEQ ID NO: 3670) | 40.000 |
| 76 | HPAQWEPVL (SEQ ID NO: 3671) | 20.000 |
| 32 | LPPSLRCSL (SEQ ID NO: 3672) | 20.000 |
| 160 | FPAHPIYDL (SEQ ID NO: 3673) | 20.000 |
| 66 | VPQASVPLL (SEQ ID NO: 3674) | 20.000 |
| 114 | TPTRQIGSI (SEQ ID NO: 3675) | 8.000 |
| 163 | HPIYDLSQV (SEQ ID NO: 3676) | 6.000 |
| 158 | EAFPAHPIY (SEQ ID NO: 3677) | 6.000 |
| 111 | LSRTPTRQI (SEQ ID NO: 3678) | 6.000 |
| 57 | APLQPTLGV (SEQ ID NO: 3679) | 4.000 |
| 125 | DPPADGPSN (SEQ ID NO: 3680) | 3.000 |
| 102 | VPHPDPPMA (SEQ ID NO: 3681) | 3.000 |
| 44 | CCSGDPASY (SEQ ID NO: 3682) | 3.000 |
| 130 | GPSNPLCCC (SEQ ID NO: 3683) | 2.000 |
| 27 | MPCSRLPPS (SEQ ID NO: 3684) | 2.000 |
| 176 | SPAPSRGQA (SEQ ID NO: 3685) | 2.000 |
| 22 | TPAGPMPCS (SEQ ID NO: 3686) | 2.000 |

TABLE XX-continued

V4-HLA-B3501-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 19 | TCATPAGPM (SEQ ID NO: 3687) | 2.000 |
| 106 | DPPMALSRT (SEQ ID NO: 3688) | 2.000 |
| 8 | WARRTSRAV (SEQ ID NO: 3689) | 1.800 |
| 12 | TSRAVTPTC (SEQ ID NO: 3690) | 1.500 |
| 147 | LNPVLRHLF (SEQ ID NO: 3691) | 1.000 |
| 146 | TLNPVLRHL (SEQ ID NO: 3692) | 1.000 |
| 65 | VVPQASVPL (SEQ ID NO: 3693) | 1.000 |
| 120 | GSIDTDPPA (SEQ ID NO: 3694) | 1.000 |
| 55 | WGAPLQPTL (SEQ ID NO: 3695) | 1.000 |
| 24 | AGPMPCSRL (SEQ ID NO: 3696) | 1.000 |
| 136 | CCCFHGPAF (SEQ ID NO: 3697) | 1.000 |
| 104 | HPDPPMALS (SEQ ID NO: 3698) | 0.609 |
| 85 | VPEAHPNAS (SEQ ID NO: 3699) | 0.600 |
| 14 | RAVTPTCAT (SEQ ID NO: 3700) | 0.600 |
| 131 | PSNPLCCCF (SEQ ID NO: 3701) | 0.500 |
| 92 | ASLTMYVCA (SEQ ID NO: 3702) | 0.500 |
| 38 | CSLHSACCS (SEQ ID NO: 3703) | 0.500 |

TABLE XX-continued

V4-HLA-B3501-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 172 | WSVVSPAPS (SEQ ID NO: 3704) | 0.500 |
| 168 | LSQVWSVVS (SEQ ID NO: 3705) | 0.500 |
| 155 | FPQEAFPAH (SEQ ID NO: 3706) | 0.400 |
| 35 | SLRCSLHSA (SEQ ID NO: 3707) | 0.300 |
| 91 | NASLTMYVC (SEQ ID NO: 3708) | 0.300 |
| 87 | EAHPNASLT (SEQ ID NO: 3709) | 0.300 |
| 177 | PAPSRGQAL (SEQ ID NO: 3710) | 0.300 |
| 46 | SGDPASYRL (SEQ ID NO: 3711) | 0.300 |
| 42 | SACCSGDPA (SEQ ID NO: 3712) | 0.300 |
| 51 | SYRLWGAPL (SEQ ID NO: 3713) | 0.300 |
| 152 | RHLFPQEAF (SEQ ID NO: 3714) | 0.200 |
| 71 | VPLLTHPAQ (SEQ ID NO: 3715) | 0.200 |
| 113 | RTPTRQIGS (SEQ ID NO: 3716) | 0.200 |
| 63 | LGVVPQASV (SEQ ID NO: 3717) | 0.200 |
| 11 | RTSRAVTPT (SEQ ID NO: 3718) | 0.200 |
| 133 | NPLCCCFHG (SEQ ID NO: 3719) | 0.200 |
| 167 | DLSQVWSVV (SEQ ID NO: 3720) | 0.200 |

TABLE XX-continued

V4-HLA-B3501-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 81 | EPVLVPEAH (SEQ ID NO: 3721) | 0.200 |
| 148 | NPVLRHLFP (SEQ ID NO: 3722) | 0.200 |
| 25 | GPMPCSRLP (SEQ ID NO: 3723) | 0.200 |
| 178 | APSRGQALR (SEQ ID NO: 3724) | 0.200 |
| 60 | QPTLGWPQ (SEQ ID NO: 3725) | 0.200 |
| 88 | AHPNASLTM (SEQ ID NO: 3726) | 0.200 |
| 94 | LTMYVCAPV (SEQ ID NO: 3727) | 0.200 |
| 100 | APVPHPDPP (SEQ ID NO: 3728) | 0.200 |
| 17 | TPTCATPAG (SEQ ID NO: 3729) | 0.200 |
| 48 | DPASYRLWG (SEQ ID NO: 3730) | 0.200 |
| 31 | RLPPSLRCS (SEQ ID NO: 3731) | 0.200 |
| 101 | PVPHPDPPM (SEQ ID NO: 3732) | 0.200 |
| 37 | RCSLHSACC (SEQ ID NO: 3733) | 0.200 |
| 4 | RTTTWARRT (SEQ ID NO: 3734) | 0.200 |
| 84 | LVPEAHPNA (SEQ ID NO: 3735) | 0.200 |
| 141 | GPAFSTLNP (SEQ ID NO: 3736) | 0.200 |
| 29 | CSRLPPSLR (SEQ ID NO: 3737) | 0.150 |

TABLE XX-continued

V4-HLA-B3501-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 83 | VLVPEAHPN (SEQ ID NO: 3738) | 0.150 |
| 21 | ATPAGPMPC (SEQ ID NO: 3739) | 0.100 |
| 16 | VTPTCATPA (SEQ ID NO: 3740) | 0.100 |
| 143 | AFSTLNPVL (SEQ ID NO: 3741) | 0.100 |
| 135 | LCCCFHGPA (SEQ ID NO: 3742) | 0.100 |
| 1 | MTHRTTTWA (SEQ ID NO: 3743) | 0.100 |
| 139 | FHGPAFSTL (SEQ ID NO: 3744) | 0.100 |
| 45 | CSGDPASYR (SEQ ID NO: 3745) | 0.100 |
| 28 | PCSRLPPSL (SEQ ID NO: 3746) | 0.100 |
| 5 | TTTWARRTS (SEQ ID NO: 3747) | 0.100 |
| 164 | PIYDLSQVW (SEQ ID NO: 3748) | 0.100 |
| 70 | SVPLLTHPA (SEQ ID NO: 3749) | 0.100 |
| 43 | ACCSGDPAS (SEQ ID NO: 3750) | 0.100 |
| 62 | TLGVVPQAS (SEQ ID NO: 3751) | 0.100 |
| 170 | QVWSVVSPA (SEQ ID NO: 3752) | 0.100 |
| 129 | DGPSNPLCC (SEQ ID NO: 3753) | 0.100 |
| 137 | CCFHGPAFS (SEQ ID NO: 3754) | 0.100 |

TABLE XX-continued

V4-HLA-B3501-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 140 | HGPAFSTLN (SEQ ID NO: 3755) | 0.100 |
| 127 | PADGPSNPL (SEQ ID NO: 3756) | 0.090 |
| 77 | PAQWEPVLV (SEQ ID NO: 3757) | 0.090 |
| 142 | PAFSTLNPV (SEQ ID NO: 3758) | 0.060 |
| 69 | ASVPLLTHP (SEQ ID NO: 3759) | 0.050 |
| 144 | FSTLNPVLR (SEQ ID NO: 3760) | 0.050 |
| 72 | PLLTHPAQW (SEQ ID NO: 3761) | 0.050 |
| 175 | VSPAPSRGQ (SEQ ID NO: 3762) | 0.050 |
| 47 | GDPASYRLW (SEQ ID NO: 3763) | 0.050 |
| 34 | PSLRCSLHS (SEQ ID NO: 3764) | 0.050 |
| 50 | ASYRLWGAP (SEQ ID NO: 3765) | 0.050 |
| 41 | HSACCSGDP (SEQ ID NO: 3766) | 0.050 |
| 157 | QEAFPAHPI (SEQ ID NO: 3767) | 0.040 |
| 126 | PPADGPSNP (SEQ ID NO: 3768) | 0.040 |
| 150 | VLRHLFPQE (SEQ ID NO: 3769) | 0.030 |

TABLE XX

V19-HLA-B3501-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 1 | GPMPCSRLL (SEQ ID NO: 3770) | 20.000 |
| 3 | MPCSRLLPS (SEQ ID NO: 3771) | 2.000 |
| 8 | LLPSLRCSL (SEQ ID NO: 3772) | 1.000 |
| 7 | RLLPSLRCS (SEQ ID NO: 3773) | 0.200 |
| 9 | LPSLRCSLH (SEQ ID NO: 3774) | 0.200 |
| 5 | CSRLLPSLR (SEQ ID NO: 3775) | 0.150 |
| 4 | PCSRLLPSL (SEQ ID NO: 3776) | 0.100 |
| 6 | SRLLPSLRC (SEQ ID NO: 3777) | 0.010 |
| 2 | PMPCSRLLP (SEQ ID NO: 3778) | 0.001 |

TABLE XX

V20-HLA-B3501-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 8 | SSRLWGAPL (SEQ ID NO: 3779) | 15.000 |
| 3 | SGDPASSRL (SEQ ID NO: 3780) | 0.300 |
| 5 | DPASSRLWG (SEQ ID NO: 3781) | 0.200 |
| 1 | CCSGDPASS (SEQ ID NO: 3782) | 0.150 |
| 2 | CSGDPASSR (SEQ ID NO: 3783) | 0.100 |

TABLE XX-continued

V20-HLA-B3501-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 4 | GDPASSRLW (SEQ ID NO: 3784) | 0.050 |
| 7 | ASSRLWGAP (SEQ ID NO: 3785) | 0.050 |
| 6 | PASSRLWGA (SEQ ID NO: 3786) | 0.030 |
| 9 | SRLWGAPLQ (SEQ ID NO: 3787) | 0.001 |

TABLE XX

V21-HLA-B3501-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 9 | DPAQWEPVL (SEQ ID NO: 3788) | 20.000 |
| 4 | VPLLTDPAQ (SEQ ID NO: 3789) | 0.200 |
| 3 | SVPLLTDPA (SEQ ID NO: 3790) | 0.100 |
| 5 | PLLTDPAQW (SEQ ID NO: 3791) | 0.075 |
| 2 | ASVPLLTDP (SEQ ID NO: 3792) | 0.050 |
| 1 | QASVPLLTD (SEQ ID NO: 3793) | 0.030 |
| 6 | LLTDPAQWE (SEQ ID NO: 3794) | 0.020 |
| 8 | TDPAQWEPV (SEQ ID NO: 3795) | 0.020 |
| 7 | LTDPAQWEP (SEQ ID NO: 3796) | 0.003 |

TABLE XX

V21&22-HLA-B3501-9MERS-PSCA
Each peptide is a portion of SEQ ID NO: 8;
each start position is specified, the
length of peptide is 9 amino acids, and
the end position for each peptide is the
start position plus eight.

| START | SUBSEQUENCE | SCORE |
|---|---|---|
| 1 | ASVPLLTDL (SEQ ID NO: 3797) | 5.000 |
| 8 | DLAQWEPVL (SEQ ID NO: 3798) | 1.000 |
| 3 | VPLLTDLAQ (SEQ ID NO: 3799) | 0.200 |
| 2 | SVPLLTDLA (SEQ ID NO: 3800) | 0.100 |
| 4 | PLLTDLAQW (SEQ ID NO: 3801) | 0.075 |
| 7 | TDLAQWEPV (SEQ ID NO: 3802) | 0.020 |
| 5 | LLTDLAQWE (SEQ ID NO: 3803) | 0.020 |
| 6 | LTDLAQWEP (SEQ ID NO: 3804) | 0.003 |

TABLE XX

V22-HLA-B3501-9MERS-PSCA
Each peptide is a portion of SEQ ID NO: 8; each start position is specified,
the length of peptide is 9 amino acids,
and the end position for each peptide
is the start position plus eight.

| START | SUBSEQUENCE | SCORE |
|---|---|---|
| 1 | ASVPLLTHL (SEQ ID NO: 3805) | 5.000 |
| 8 | HLAQWEPVL (SEQ ID NO: 3806) | 1.000 |
| 9 | LAQWEPVLV (SEQ ID NO: 3807) | 0.900 |
| 3 | VPLLTHLAQ (SEQ ID NO: 3808) | 0.200 |
| 2 | SVPLLTHLA (SEQ ID NO: 3809) | 0.100 |
| 4 | PLLTHLAQW (SEQ ID NO: 3810) | 0.059 |

TABLE XX-continued

V22-HLA-B3501-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 7 | THLAQWEPV (SEQ ID NO: 3811) | 0.020 |
| 6 | LTHLAQWEP (SEQ ID NO: 3812) | 0.010 |
| 5 | LLTHLAQWE (SEQ ID NO: 3813) | 0.010 |

TABLE XX

V24-HLA-B3501-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 1 | ASLTMYVCT (SEQ ID NO: 3814) | 5.000 |
| 3 | LTMYVCTPV (SEQ ID NO: 3815) | 0.200 |
| 7 | VCTPVPHPD (SEQ ID NO: 3816) | 0.010 |
| 6 | YVCTPVPHP (SEQ ID NO: 3817) | 0.010 |
| 4 | TMYVCTPVP (SEQ ID NO: 3818) | 0.010 |
| 8 | CTPVPHPDP (SEQ ID NO: 3819) | 0.010 |
| 2 | SLTMYVCTP (SEQ ID NO: 3820) | 0.010 |
| 5 | MYVCTPVPH (SEQ ID NO: 3821) | 0.001 |

TABLE XX

V25-HLA-B3501-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 3 | TPTRQISSI (SEQ ID NO: 3822) | 8.000 |
| 9 | SSIDTDPPA (SEQ ID NO: 3823) | 1.000 |
| 2 | RTPTRQISS (SEQ ID NO: 3824) | 0.200 |
| 8 | ISSIDTDPP (SEQ ID NO: 3825) | 0.075 |
| 6 | RQISSIDTD (SEQ ID NO: 3826) | 0.020 |
| 7 | QISSIDTDP (SEQ ID NO: 3827) | 0.010 |
| 5 | TRQISSIDT (SEQ ID NO: 3828) | 0.010 |
| 1 | SRTPTRQIS (SEQ ID NO: 3829) | 0.010 |
| 4 | PTRQISSID (SEQ ID NO: 3830) | 0.003 |

TABLE XX

V25&26-HLA-B3501-9MERS-PSCA
Each peptide is a portion of SEQ ID NO: 8; each start position is specified, the length of peptide is 9 amino acids, and the end position for each peptide is the start position plus eight.

| START | SUBSEQUENCE | SCORE |
|---|---|---|
| 1 | TPTRQISSS (SEQ ID NO: 3831) | 2.000 |
| 7 | SSSDTDPPA (SEQ ID NO: 3832) | 1.000 |
| 6 | ISSSDTDPP (SEQ ID NO: 3833) | 0.075 |
| 4 | RQISSSDTD (SEQ ID NO: 3834) | 0.020 |
| 5 | QISSSDTDP (SEQ ID NO: 3835) | 0.010 |

TABLE XX-continued

V25&26-HLA-B3501-9MERS-PSCA
Each peptide is a portion of SEQ
ID NO: 8; each start position is
specified, the length of peptide is 9
amino acids, and the end position
for each peptide is the start
position plus eight.

| START | SUBSEQUENCE | SCORE |
|---|---|---|
| 3 | TRQISSSDT (SEQ ID NO: 3836) | 0.010 |
| 2 | PTRQISSSD (SEQ ID NO: 3837) | 0.003 |

TABLE XX

V26-HLA-B3501-9MERS-PSCA
Each peptide is a portion of SEQ ID
NO: 8; each start position is specified,
the length of peptide is 9 amino acids,
and the end position for each peptide
is the start position plus eight.

| START | SUBSEQUENCE | SCORE |
|---|---|---|
| 1 | TPTRQIGSS (SEQ ID NO: 3838) | 2.000 |
| 7 | GSSDTDPPA (SEQ ID NO: 3839) | 1.000 |
| 8 | SSDTDPPAD (SEQ ID NO: 3840) | 0.023 |
| 4 | RQIGSSDTD (SEQ ID NO: 3841) | 0.020 |
| 6 | IGSSDTDPP (SEQ ID NO: 3842) | 0.015 |
| 5 | QIGSSDTDP (SEQ ID NO: 3843) | 0.010 |
| 3 | TRQIGSSDT (SEQ ID NO: 3844) | 0.010 |
| 2 | PTRQIGSSD (SEQ ID NO: 3845) | 0.003 |
| 9 | SDTDPPADG (SEQ ID NO: 3846) | 0.002 |

TABLE XX

V27-HLA-B3501-9MERS-PSCA
Each peptide is a portion of SEQ ID
NO: 8; each start position is specified,
the length of peptide is 9 amino acids,
and the end position for each peptide
is the start position plus eight.

| START | SUBSEQUENCE | SCORE |
|---|---|---|
| 2 | RGQALRRAQ (SEQ ID NO: 3847) | 0.020 |
| 1 | SRGQALRRA (SEQ ID NO: 3848) | 0.010 |

TABLE XXI

V1-HLA-B3501-10MERS-PSCA
Each peptide is a portion of SEQ ID
NO: 2; each start position is specified,
the length of peptide is 10 amino
acids, and the end position for each
peptide is the start position plus nine.

| START | SUBSEQUENCE | SCORE |
|---|---|---|
| 101 | QPAAAILALL (SEQ ID NO: 3849) | 20.000 |
| 50 | TARIRAVGLL (SEQ ID NO: 3850) | 9.000 |
| 27 | KAQVSNEDCL (SEQ ID NO: 3851) | 6.000 |
| 69 | NCVDDSQDYY (SEQ ID NO: 3852) | 4.000 |
| 98 | HALQPAAAJL (SEQ ID NO: 3853) | 3.000 |
| 6 | LALLMAGLAL (SEQ ID NO: 3854) | 3.000 |
| 62 | ISKGCSLNCV (SEQ ID NO: 3855) | 3.000 |
| 104 | AAILALLPAL (SEQ ID NO: 3856) | 3.000 |
| 107 | LALLPALGLL (SEQ ID NO: 3857) | 3.000 |
| 13 | LALQPGTALL (SEQ ID NO: 3858) | 3.000 |
| 68 | LNCVDDSQDY (SEQ ID NO: 3859) | 3.000 |
| 82 | KNITCCDTDL (SEQ ID NO: 3860) | 2.000 |

TABLE XXI-continued

V1-HLA-B3501-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 16 | QPGTALLCYS (SEQ ID NO: 3861) | 2.000 |
| 15 | LQPGTALLCY (SEQ ID NO: 3862) | 2.000 |
| 52 | RIRAVGLLTV (SEQ ID NO: 3863) | 1.200 |
| 100 | LQPAAAILAL (SEQ ID NO: 3864) | 1.000 |
| 108 | ALLPALGLLL (SEQ ID NO: 3865) | 1.000 |
| 114 | GLLLWGPGQL (SEQ ID NO: 3866) | 1.000 |
| 59 | LTVISKGCSL (SEQ ID NO: 3867) | 1.000 |
| 106 | ILALLPALGL (SEQ ID NO: 3868) | 1.000 |
| 4 | VLLALLMAGL (SEQ ID NO: 3869) | 1.000 |
| 49 | WTARIRAVGL (SEQ ID NO: 3870) | 1.000 |
| 91 | LCNASGAHAL (SEQ ID NO: 3871) | 1.000 |
| 12 | GLALQPGTAL (SEQ ID NO: 3872) | 1.000 |
| 35 | CLQVENCTQL (SEQ ID NO: 3873) | 1.000 |
| 54 | RAVGLLTVIS (SEQ ID NO: 3874) | 0.600 |
| 2 | KAVLLALLMA (SEQ ID NO: 3875) | 0.600 |
| 109 | LLPALGLLLW (SEQ ID NO: 3876) | 0.500 |
| 94 | ASGAHALQPA (SEQ ID NO: 3877) | 0.500 |
| 40 | NCTQLGEQCW (SEQ ID NO: 3878) | 0.500 |
| 10 | MAGLALQPGT (SEQ ID NO: 3879) | 0.300 |
| 19 | TALLCYSCKA (SEQ ID NO: 3880) | 0.300 |
| 96 | GAHALQPAAA (SEQ ID NO: 3881) | 0.300 |
| 103 | AAAILALLPA (SEQ ID NO: 3882) | 0.300 |
| 85 | TCCDTDLCNA (SEQ ID NO: 3883) | 0.300 |
| 29 | QVSNEDCLQV (SEQ ID NO: 3884) | 0.300 |
| 21 | LLCYSCKAQV (SEQ ID NO: 3885) | 0.200 |
| 1 | MKAVLLALLM (SEQ ID NO: 3886) | 0.200 |
| 47 | QCWTARIRAV (SEQ ID NO: 3887) | 0.200 |
| 110 | LPALGLLLWG (SEQ ID NO: 3888) | 0.200 |
| 41 | CTQLGEQCWT (SEQ ID NO: 3889) | 0.150 |
| 83 | NITCCDTDLC (SEQ ID NO: 3890) | 0.150 |
| 44 | LGEQCWTARI (SEQ ID NO: 3891) | 0.120 |
| 70 | CVDDSQDYYV (SEQ ID NO: 3892) | 0.120 |
| 14 | ALQPGTALLC (SEQ ID NO: 3893) | 0.100 |
| 58 | LLTVISKGCS (SEQ ID NO: 3894) | 0.100 |

TABLE XXI-continued

V1-HLA-B3501-10MERS-PSCA
Each peptide is a portion of SEQ ID NO: 2; each start position is specified, the length of peptide is 10 amino acids, and the end position for each peptide is the start position plus nine.

| START | SUBSEQUENCE | SCORE |
|---|---|---|
| 73 | DSQDYYVGKK (SEQ ID NO: 3895) | 0.100 |
| 5 | LLALLMAGLA (SEQ ID NO: 3896) | 0.100 |
| 42 | TQLGEQCWTA (SEQ ID NO: 3897) | 0.100 |
| 84 | ITCCDTDLCN (SEQ ID NO: 3898) | 0.100 |
| 61 | VISKGCSLNC (SEQ ID NO: 3899) | 0.100 |
| 65 | GCSLNCVDDS (SEQ ID NO: 3900) | 0.100 |
| 22 | LCYSCKAQVS (SEQ ID NO: 3901) | 0.100 |
| 95 | SGAHALQPAA (SEQ ID NO: 3902) | 0.100 |
| 78 | YVGKKNITCC (SEQ ID NO: 3903) | 0.100 |
| 90 | DLCNASGAHA (SEQ ID NO: 3904) | 0.100 |
| 46 | EQCWTARIRA (SEQ ID NO: 3905) | 0.100 |
| 30 | VSNEDCLQVE (SEQ ID NO: 3906) | 0.100 |
| 99 | ALQPAAAILA (SEQ ID NO: 3907) | 0.100 |
| 57 | GLLTVISKGC (SEQ ID NO: 3908) | 0.100 |
| 60 | TVISKGCSLN (SEQ ID NO: 3909) | 0.100 |
| 39 | ENCTQLGEQC (SEQ ID NO: 3910) | 0.100 |
| 11 | AGLALQPGTA (SEQ ID NO: 3911) | 0.100 |
| 31 | SNEDCLQVEN (SEQ ID NO: 3912) | 0.060 |
| 24 | YSCKAQVSNE (SEQ ID NO: 3913) | 0.050 |
| 66 | CSLNCVDDSQ (SEQ ID NO: 3914) | 0.050 |
| 97 | AHALQPAAAI (SEQ ID NO: 3915) | 0.040 |
| 75 | QDYYVGKKNI (SEQ ID NO: 3916) | 0.040 |
| 53 | IRAVGLLTVI (SEQ ID NO: 3917) | 0.040 |
| 25 | SCKAQVSNED (SEQ ID NO: 3918) | 0.030 |
| 79 | VGKKNITCCD (SEQ ID NO: 3919) | 0.030 |
| 93 | NASGAHALQP (SEQ ID NO: 3920) | 0.030 |
| 80 | GKKNITCCDT (SEQ ID NO: 3921) | 0.030 |
| 74 | SQDYYVGKKN (SEQ ID NO: 3922) | 0.030 |
| 86 | CCDTDLCNAS (SEQ ID NO: 3923) | 0.030 |
| 88 | DTDLCNASGA (SEQ ID NO: 3924) | 0.030 |
| 36 | LQVENCTQLG (SEQ ID NO: 3925) | 0.020 |
| 64 | DGCSLNCVDD (SEQ ID NO: 3926) | 0.020 |
| 43 | QLGEQCWTAR (SEQ ID NO: 3927) | 0.020 |
| 28 | AQVSNEDCLQ (SEQ ID NO: 3928) | 0.015 |

TABLE XXI-continued

V1-HLA-B3501-10MERS-PSCA
Each peptide is a portion of SEQ ID
NO: 2; each start position is specified,
the length of peptide is 10 amino
acids, and the end position for each
peptide is the start position plus nine.

| START | SUBSEQUENCE | SCORE |
|---|---|---|
| 34 | CDLQVENCTQ (SEQ ID NO: 3929) | 0.015 |
| 67 | SLNCVDDSQD (SEQ ID NO: 3930) | 0.015 |
| 105 | AILALLPALG (SEQ ID NO: 3931) | 0.010 |
| 76 | DYYVGKKNIT (SEQ ID NO: 3932) | 0.010 |
| 33 | EDCLQVENCT (SEQ ID NO: 3933) | 0.010 |
| 26 | CKAQVSNEDC (SEQ ID NO: 3934) | 0.010 |
| 56 | VGLLTVISKG (SEQ ID NO: 3935) | 0.010 |
| 112 | ALGLLLWGPG (SEQ ID NO: 3936) | 0.010 |
| 3 | AVLLALLMAG (SEQ ID NO: 3937) | 0.010 |
| 55 | AVGLLTVISK (SEQ ID NO: 3938) | 0.010 |
| 9 | LMAGLALQPG (SEQ ID NO: 3939) | 0.010 |
| 51 | ARIRAVGLLT (SEQ ID NO: 3940) | 0.010 |
| 20 | ALLCYSCKAQ (SEQ ID NO: 3941) | 0.010 |
| 92 | CNASGAHALQ (SEQ ID NO: 3942) | 0.010 |
| 8 | LLMAGLALQP (SEQ ID NO: 3943) | 0.010 |
| 113 | LGLLLWGPGQ (SEQ ID NO: 3944) | 0.010 |
| 18 | GTALLCYSCK (SEQ ID NO: 3945) | 0.010 |

TABLE XXI-continued

V1-HLA-B3501-10MERS-PSCA
Each peptide is a portion of SEQ ID
NO: 2; each start position is specified,
the length of peptide is 10 amino
acids, and the end position for each
peptide is the start position plus nine.

| START | SUBSEQUENCE | SCORE |
|---|---|---|
| 7 | ALLMAGLALQ (SEQ ID NO: 3946) | 0.010 |
| 77 | YYVGKKNITC (SEQ ID NO: 3947) | 0.010 |
| 23 | CYSCKAQVSN (SEQ ID NO: 3948) | 0.010 |

TABLE XXI

V4-HLA-B3501-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 100 | APVPHDPPPM (SEQ ID NO: 3949) | 40.000 |
| 130 | GPSNPLCCCF (SEQ ID NO: 3950) | 20.000 |
| 176 | SPAPSRGQAL (SEQ ID NO: 3951) | 20.000 |
| 27 | MPCSRLPPSL (SEQ ID NO: 3952) | 20.000 |
| 102 | VPHDPPPMAL (SEQ ID NO: 3953) | 20.000 |
| 45 | CSGDPASYRL (SEQ ID NO: 3954) | 10.000 |
| 163 | HPIYDLSQVW (SEQ ID NO: 3955) | 10.000 |
| 71 | VPLLTHPAQW (SEQ ID NO: 3956) | 10.000 |
| 85 | VPEAHPNASL (SEQ ID NO: 3957) | 6.000 |
| 87 | EAHPNASLTM (SEQ ID NO: 3958) | 6.000 |
| 76 | HPAQWEPVLV (SEQ ID NO: 3959) | 6.000 |

TABLE XXI-continued

V4-HLA-B3501-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 50 | ASYRLWGAPL (SEQ ID NO: 3960) | 5.000 |
| 141 | GPAFSTLNPV (SEQ ID NO: 3961) | 4.000 |
| 57 | APLQPTLGVV (SEQ ID NO: 3962) | 4.000 |
| 89 | HPNASLTMYV (SEQ ID NO: 3963) | 4.000 |
| 126 | PPADGPSNPL (SEQ ID NO: 3964) | 4.000 |
| 43 | ACCSGDPASY (SEQ ID NO: 3965) | 3.000 |
| 60 | QPTLGVVPQA (SEQ ID NO: 3966) | 2.000 |
| 66 | VPQASVPLLT (SEQ ID NO: 3967) | 2.000 |
| 31 | RLPPSLRCSL (SEQ ID NO: 3968) | 2.000 |
| 160 | FPAHPIYDLS (SEQ ID NO: 3969) | 2.000 |
| 48 | DPASYRLWGA (SEQ ID NO: 3970) | 2.000 |
| 12 | TSRAVTPTCA (SEQ ID NO: 3971) | 1.500 |
| 29 | CSRLPPSLRC (SEQ ID NO: 3972) | 1.500 |
| 135 | LCCCFHGPAF (SEQ ID NO: 3973) | 1.000 |
| 65 | VVPQASVPLL (SEQ ID NO: 3974) | 1.000 |
| 146 | TLNPVLRHLF (SEQ ID NO: 3975) | 1.000 |
| 64 | GVVPQASVPL (SEQ ID NO: 3976) | 1.000 |

TABLE XXI-continued

V4-HLA-B3501-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 145 | STLNPVLRHL (SEQ ID NO: 3977) | 1.000 |
| 8 | WARRTSRAVT (SEQ ID NO: 3978) | 0.900 |
| 113 | RTPTRQIGSI (SEQ ID NO: 3979) | 0.800 |
| 56 | GAPLQPTLGV (SEQ ID NO: 3980) | 0.600 |
| 69 | ASVPLLTHPA (SEQ ID NO: 3981) | 0.500 |
| 175 | VSPAPSRGQA (SEQ ID NO: 3982) | 0.500 |
| 41 | HSACCSGDPA (SEQ ID NO: 3983) | 0.500 |
| 155 | FPQEAFPAHP (SEQ ID NO: 3984) | 0.409 |
| 110 | ALSRTPTRQI (SEQ ID NO: 3985) | 0.400 |
| 35 | SLRCSLHSAC (SEQ ID NO: 3986) | 0.300 |
| 20 | CAPPAGPMPC (SEQ ID NO: 3987) | 0.300 |
| 91 | NASLTMYVCA (SEQ ID NO: 3988) | 0.300 |
| 142 | PAFSTLNPVL (SEQ ID NO: 3989) | 0.300 |
| 150 | VLRHLFPQEA (SEQ ID NO: 3990) | 0.300 |
| 42 | SACCSGDPAS (SEQ ID NO: 3991) | 0.300 |
| 23 | PAGPMPCSRL (SEQ ID NO: 3992) | 0.300 |
| 53 | RLWGAPLQPT (SEQ ID NO: 3993) | 0.200 |

TABLE XXI-continued

V4-HLA-B3501-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 32 | LPPSLRCSLH (SEQ ID NO: 3994) | 0.200 |
| 125 | DPPADGPSNP (SEQ ID NO: 3995) | 0.200 |
| 74 | LTHPAQWEPV (SEQ ID NO: 3996) | 0.200 |
| 11 | RTSRAVTPTC (SEQ ID NO: 3997) | 0.200 |
| 148 | NPVLRHLFPQ (SEQ ID NO: 3998) | 0.200 |
| 18 | PTCATPAGPM (SEQ ID NO: 3999) | 0.200 |
| 81 | EPVLVPEAHP (SEQ ID NO: 4000) | 0.200 |
| 84 | LVPEAHPNAS (SEQ ID NO: 4001) | 0.200 |
| 106 | DPPMALSRTP (SEQ ID NO: 4002) | 0.200 |
| 25 | GPMPGSRLPP (SEQ ID NO: 4003) | 0.200 |
| 33 | PPSLRCSLHS (SEQ ID NO: 4004) | 0.200 |
| 178 | APSRGQALRR (SEQ ID NO: 4005) | 0.200 |
| 22 | TPAGPMPGSR (SEQ ID NO: 4006) | 0.200 |
| 4 | RTTTWARRTS (SEQ ID NO: 4007) | 0.200 |
| 17 | TPTCATPAGP (SEQ ID NO: 4008) | 0.200 |
| 93 | SLTMYVCAPV (SEQ ID NO: 4009) | 0.200 |
| 37 | RCSLHSACCS (SEQ ID NO: 4010) | 0.200 |

TABLE XXI-continued

V4-HLA-B3501-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 133 | NPLCCCFHGP (SEQ ID NO: 4011) | 0.200 |
| 62 | TLGVVPQASV (SEQ ID NO: 4012) | 0.200 |
| 157 | QEAFPAHPIY (SEQ ID NO: 4013) | 0.200 |
| 88 | AHPNASLTMY (SEQ ID NO: 4014) | 0.200 |
| 107 | PPMALSRTPT (SEQ ID NO: 4015) | 0.200 |
| 114 | TPTRQIGSID (SEQ ID NO: 4016) | 0.200 |
| 120 | GSIDTDPPAD (SEQ ID NO: 4017) | 0.150 |
| 46 | SGDPASYRLW (SEQ ID NO: 4018) | 0.150 |
| 111 | LSRTPTRQIG (SEQ ID NO: 4019) | 0.150 |
| 153 | HLFPQEAFPA (SEQ ID NO: 4020) | 0.150 |
| 179 | PSRGQALRRA (SEQ ID NO: 4021) | 0.150 |
| 15 | AVTPTCATPA (SEQ ID NO: 4022) | 0.100 |
| 119 | IGSIDTDPPA (SEQ ID NO: 4023) | 0.100 |
| 83 | VLVPEAHPNA (SEQ ID NO: 4024) | 0.100 |
| 6 | TTWARRTSRA (SEQ ID NO: 4025) | 0.100 |
| 151 | LRHLFPQEAF (SEQ ID NO: 4026) | 0.100 |
| 54 | LWGAPLQPTL (SEQ ID NO: 4027) | 0.100 |

TABLE XXI-continued

V4-HLA-B3501-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 129 | DGPSNPLCCC (SEQ ID NO: 4028) | 0.100 |
| 21 | ATPAGPMPCS (SEQ ID NO: 4029) | 0.100 |
| 167 | DLSQVWSVVS (SEQ ID NO: 4030) | 0.100 |
| 138 | CFHGPAFSTL (SEQ ID NO: 4031) | 0.100 |
| 159 | AFPAHPIYDL (SEQ ID NO: 4032) | 0.100 |
| 169 | SQVWSVVSPA (SEQ ID NO: 4033) | 0.100 |
| 75 | THPAQWEPVL (SEQ ID NO: 4034) | 0.100 |
| 136 | CCCFHGPAFS (SEQ ID NO: 4035) | 0.100 |
| 137 | CCFHGPAFST (SEQ ID NO: 4036) | 0.100 |
| 104 | HPDPPMALSR (SEQ ID NO: 4037) | 0.060 |
| 14 | RAVTPTCATP (SEQ ID NO: 4038) | 0.060 |
| 38 | CSLHSACCSG (SEQ ID NO: 4039) | 0.050 |
| 172 | WSVVSPAPSR (SEQ ID NO: 4040) | 0.050 |
| 92 | ASLTMYVCAP (SEQ ID NO: 4041) | 0.050 |
| 144 | FSTLNPVLRH (SEQ ID NO: 4042) | 0.050 |
| 168 | LSQVWSVVSP (SEQ ID NO: 4043) | 0.050 |
| 34 | PSLRCSLHSA (SEQ ID NO: 4044) | 0.050 |

TABLE XXI-continued

V4-HLA-B3501-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 158 | EAFPAHPIYD (SEQ ID NO: 4045) | 0.030 |
| 162 | AHPIYDLSQV (SEQ ID NO: 4046) | 0.030 |
| 99 | CAPVPHPDPP (SEQ ID NO: 4047) | 0.030 |
| 68 | QASVPLLTHP (SEQ ID NO: 4048) | 0.030 |

TABLE XXI

V19-HLA-B3501-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 4 | MPCSRLLPSL (SEQ ID NO: 4049) | 20.000 |
| 8 | RLLPSLRCSL (SEQ ID NO: 4050) | 2.000 |
| 10 | LPSLRCSLHS (SEQ ID NO: 4051) | 2.000 |
| 6 | CSRLLPSLRC (SEQ ID NO: 4052) | 1.500 |
| 1 | AGPMPCSRLL (SEQ ID NO: 4053) | 1.000 |
| 2 | GPMPCSRLLP (SEQ ID NO: 4054) | 0.200 |
| 7 | SRLLPSLRCS (SEQ ID NO: 4055) | 0.010 |
| 3 | PMPCSRLLPS (SEQ ID NO: 4056) | 0.010 |
| 9 | LLPSLRCSLH (SEQ ID NO: 4057) | 0.010 |
| 5 | PCSRLLPSLR (SEQ ID NO: 4058) | 0.001 |

TABLE XXI

V20-HLA-B3501-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 3 | CSGDPASSRL (SEQ ID NO: 4059) | 10.000 |
| 8 | ASSRLWGAPL (SEQ ID NO: 4060) | 5.000 |
| 6 | DPASSRLWGA (SEQ ID NO: 4061) | 2.000 |
| 9 | SSRLWGAPLQ (SEQ ID NO: 4062) | 0.150 |
| 1 | ACCSGDPASS (SEQ ID NO: 4063) | 0.150 |
| 4 | SGDPASSRLW (SEQ ID NO: 4064) | 0.150 |
| 2 | CCSGDPASSR (SEQ ID NO: 4065) | 0.010 |
| 7 | PASSRLWGAP (SEQ ID NO: 4066) | 0.003 |
| 10 | SRLWGAPLQP (SEQ ID NO: 4067) | 0.001 |
| 5 | GDPASSRLWG (SEQ ID NO: 4068) | 0.001 |

TABLE XXI

V21-HLA-B3501-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 5 | VPLLTDPAQW (SEQ ID NO: 4069) | 15.000 |
| 10 | DPAQWEPVLV (SEQ ID NO: 4070) | 6.000 |
| 3 | ASVPLLTDPA (SEQ ID NO: 4071) | 0.500 |
| 9 | TDPAQWEPVL (SEQ ID NO: 4072) | 0.100 |
| 8 | LTDPAQWEPV (SEQ ID NO: 4073) | 0.060 |
| 2 | QASVPLLTDP (SEQ ID NO: 4074) | 0.030 |
| 7 | LLTDPAQWEP (SEQ ID NO: 4075) | 0.020 |
| 4 | SVPLLTDPAQ (SEQ ID NO: 4076) | 0.010 |
| 6 | PLLTDPAQWE (SEQ ID NO: 4077) | 0.001 |
| 1 | PQASVPLLTD (SEQ ID NO: 4078) | 0.001 |

TABLE XXI

V21&22-HLA-B3501-10MERS-PSCA
Each peptide is a portion of SEQ ID NO: 8;
each start position is specified, the
length of peptide is 10 amino acids, and
the end position for each peptide is the
start position plus nine.

| START | SUBSEQUENCE | SCORE |
|---|---|---|
| 4 | VPLLTDLAQW (SEQ ID NO: 4079) | 15.000 |
| 1 | QASVPLLTDL (SEQ ID NO: 4080) | 3.000 |
| 2 | ASVPLLTDLA (SEQ ID NO: 4081) | 0.500 |
| 9 | DLAQWEPVLV (SEQ ID NO: 4082) | 0.300 |
| 8 | TDLAQWEPVL (SEQ ID NO: 4083) | 0.100 |
| 7 | LTDLAQWEPV (SEQ ID NO: 4084) | 0.060 |
| 6 | LLTDLAQWEP (SEQ ID NO: 4085) | 0.020 |
| 3 | SVPLLTDLAQ (SEQ ID NO: 4086) | 0.010 |

TABLE XXI-continued

V21&22-HLA-B3501-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 5 | PLLTDLAQWE (SEQ ID NO: 4087) | 0.001 |

TABLE XXI

V22-HLA-B3501-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 4 | VPLLTHLAQW (SEQ ID NO: 4088) | 10.000 |
| 1 | QASVPLLTHL (SEQ ID NO: 4089) | 3.000 |
| 2 | ASVPLLTHLA (SEQ ID NO: 4090) | 0.500 |
| 9 | HLAQWEPVLV (SEQ ID NO: 4091) | 0.300 |
| 7 | LTHLAQWEPV (SEQ ID NO: 4092) | 0.200 |
| 8 | THLAQWEPVL (SEQ ID NO: 4093) | 0.100 |
| 10 | LAQWEPVLVP (SEQ ID NO: 4094) | 0.030 |
| 3 | SVPLLTHLAQ (SEQ ID NO: 4095) | 0.010 |
| 6 | LLTHLAQWEP (SEQ ID NO: 4096) | 0.010 |
| 5 | PLLTHLAQWE (SEQ ID NO: 4097) | 0.001 |

TABLE XXI

V24-HLA-B3501-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 10 | TPVPHPDPPM (SEQ ID NO: 4098) | 40.000 |
| 1 | NASLTMYVCT (SEQ ID NO: 4099) | 0.300 |
| 3 | SLTMYVCTPV (SEQ ID NO: 4100) | 0.200 |
| 2 | ASLTMYVCTP (SEQ ID NO: 4101) | 0.050 |
| 7 | YVCTPVPHPD (SEQ ID NO: 4102) | 0.010 |
| 8 | VCTPVPHPDP (SEQ ID NO: 4103) | 0.010 |
| 4 | LTMYVCTPVP (SEQ ID NO: 4104) | 0.010 |
| 9 | CTPVPHPDPP (SEQ ID NO: 4105) | 0.010 |
| 5 | TMYVCTPVPH (SEQ ID NO: 4106) | 0.010 |
| 6 | MYVCTPVPHP (SEQ ID NO: 4107) | 0.001 |

TABLE XXI

V25-HLA-B3501-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 1 | LSRTPTRQIS (SEQ ID NO: 4108) | 1.500 |
| 3 | RTPTRQISSI (SEQ ID NO: 4109) | 0.800 |
| 9 | ISSIDTDPPA (SEQ ID NO: 4110) | 0.500 |
| 4 | TPTRQISSID (SEQ ID NO: 4111) | 0.200 |

TABLE XXI-continued

V25-HLA-B3501-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 10 | SSIDTDPPAD (SEQ ID NO: 4112) | 0.150 |
| 5 | PTRQISSIDT (SEQ ID NO: 4113) | 0.030 |
| 7 | RQISSIDTDP (SEQ ID NO: 4114) | 0.020 |
| 8 | QISSIDTDPP (SEQ ID NO: 4115) | 0.015 |
| 2 | SRTPTRQISS (SEQ ID NO: 4116) | 0.010 |
| 6 | TRQISSIDTD (SEQ ID NO: 4117) | 0.001 |

TABLE XXI

V25&26-HLA-B3501-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 7 | ISSSDTDPPA (SEQ ID NO: 4118) | 0.500 |
| 1 | RTPTRQISSS (SEQ ID NO: 4119) | 0.200 |
| 2 | TPTRQISSSD (SEQ ID NO: 4120) | 0.200 |
| 8 | SSSDTDPPAD (SEQ ID NO: 4121) | 0.150 |
| 3 | PTRQISSSDT (SEQ ID NO: 4122) | 0.030 |
| 5 | RQISSSDTDP (SEQ ID NO: 4123) | 0.020 |
| 6 | QISSSDTDPP (SEQ ID NO: 4124) | 0.015 |
| 4 | TRQISSSDTD (SEQ ID NO: 4125) | 0.001 |

TABLE XXI

V26-HLA-B3501-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 1 | RTPTRQIGSS (SEQ ID NO: 4126) | 0.200 |
| 2 | TPTRQISSSD (SEQ ID NO: 4127) | 0.200 |
| 8 | GSSDTDPPAD (SEQ ID NO: 4128) | 0.150 |
| 7 | IGSSDTDPPA (SEQ ID NO: 4128) | 0.100 |
| 3 | PTRQIGSSDT (SEQ ID NO: 4129) | 0.030 |
| 5 | RQIGSSDTDP (SEQ ID NO: 4130) | 0.020 |
| 9 | SSDTDPPADG (SEQ ID NO: 4131) | 0.015 |
| 6 | QIGSSDTDPP (SEQ ID NO: 4132) | 0.015 |
| 10 | SDTDPPADGP (SEQ ID NO: 4133) | 0.002 |
| 4 | TRQIGSSDTD (SEQ ID NO: 4134) | 0.001 |

TABLE XXI

V27-HLA-B3501-10MERS-PSCA
Each peptide is a portion of SEQ ID NO: 8; each start position is specified, the length of peptide is 10 amino acids, and the end position for each peptide is the start position plus nine.

| START | SUBSEQUENCE | SCORE |
|---|---|---|
| 1 | PSRGQALRRA (SEQ ID NO: 4136) | 0.150 |
| 2 | SRGQALRRAQ (SEQ ID NO: 4137) | 0.001 |

TABLE XXII

V1-HLA-A1-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 70 | CVDDSQDYY (SEQ ID NO: 4138) | 25 |
| 16 | QPGTALLCY (SEQ ID NO: 4139) | 21 |
| 88 | DTDLCNASG (SEQ ID NO: 4140) | 17 |
| 74 | SQDYYVGKK (SEQ ID NO: 4141) | 16 |
| 69 | NCVDDSQDY (SEQ ID NO: 4142) | 15 |
| 31 | SNEDCLQVE (SEQ ID NO: 4143) | 13 |
| 71 | VDDSQDYYV (SEQ ID NO: 4144) | 13 |
| 37 | QVENCTQLG (SEQ ID NO: 4145) | 12 |

TABLE XXII

V4-HLA-A1-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 123 | DTDPPADGP (SEQ ID NO: 4146) | 21 |
| 158 | EAFPAHPIY (SEQ ID NO: 4147) | 19 |
| 104 | HPDPPMALS (SEQ ID NO: 4148) | 17 |
| 44 | CCSGDPASY (SEQ ID NO: 4149) | 16 |
| 46 | SGDPASYRL (SEQ ID NO: 4150) | 16 |
| 79 | QWEPVLVPE (SEQ ID NO: 4151) | 16 |
| 89 | HPNASLTMY (SEQ ID NO: 4152) | 16 |
| 145 | STLNPVLRH (SEQ ID NO: 4153) | 16 |
| 30 | SRLPPSLRC (SEQ ID NO: 4154) | 13 |
| 179 | PSRGQALRR (SEQ ID NO: 4155) | 13 |
| 121 | SIDTDPPAD (SEQ ID NO: 4156) | 12 |
| 127 | PADGPSNPL (SEQ ID NO: 4157) | 12 |
| 85 | VPEAHPNAS (SEQ ID NO: 4158) | 11 |
| 34 | PSLRCSLHS (SEQ ID NO: 4159) | 10 |
| 61 | PTLGVVPQA (SEQ ID NO: 4160) | 10 |
| 67 | PQASVPLLT (SEQ ID NO: 4161) | 10 |
| 74 | LTHPAQWEP (SEQ ID NO: 4162) | 10 |
| 78 | AQWEPVLVP (SEQ ID NO: 4163) | 10 |
| 105 | PDPPMALSR (SEQ ID NO: 4164) | 10 |
| 113 | RTPTRQIGS (SEQ ID NO: 4165) | 10 |
| 156 | PQEAFPAHP (SEQ ID NO: 4166) | 10 |
| 165 | IYDLSQVWS (SEQ ID NO: 4167) | 10 |

TABLE XXII

V19-HLA-A1-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 2 | PMPCSRLLP (SEQ ID NO: 4168) | 9 |
| 6 | SRLLPSLRC (SEQ ID NO: 4169) | 9 |
| 1 | GPMPCSRLL (SEQ ID NO: 4170) | 6 |
| 3 | MPCSRLLPS (SEQ ID NO: 4171) | 6 |
| 5 | CSRLLPSLR (SEQ ID NO: 4172) | 6 |
| 7 | RLLPSLRCS (SEQ ID NO: 4173) | 5 |

TABLE XXII

V20-HLA-A1-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | SGDPASSRL (SEQ ID NO: 4174) | 16 |
| 5 | DPASSRLWG (SEQ ID NO: 4175) | 7 |
| 8 | SSRLWGAPL (SEQ ID NO: 4176) | 7 |

TABLE XXII

V21-HLA-A1-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 7 | LTDPAQWEP (SEQ ID NO: 4177) | 20 |
| 2 | ASVPLLTDP (SEQ ID NO: 4178) | 9 |

TABLE XXII

V21&22-HLA-A1-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 6 | LTDLAQWEP (SEQ ID NO: 4179) | 16 |
| 1 | ASVPLLTDL (SEQ ID NO: 4180) | 9 |
| 3 | VPLLTDLAQ (SEQ ID NO: 4181) | 7 |

TABLE XXII

V22-HLA-A1-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | AVPLLTHL (SEQ ID NO: 4182) | 9 |
| 3 | VPLLTHLAQ (SEQ ID NO: 4183) | 7 |
| 6 | LTHLAQWEP (SEQ ID NO: 4184) | 6 |
| 2 | SVPLLTHLA (SEQ ID NO: 4185) | 4 |

TABLE XXII

V24-HLA-A1-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | LTMYVCTPV (SEQ ID NO: 4186) | 8 |
| 7 | VCTPVPHPD (SEQ ID NO: 4187) | 7 |
| 8 | CTPVPHPDP (SEQ ID NO: 4188) | 7 |
| 1 | ASLTMYVCT (SEQ ID NO: 4189) | 5 |

TABLE XXII-continued

V24-HLA-A1-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 2 | SLTMYVCTP (SEQ ID NO: 4190) | 5 |
| 6 | YVCTPVPHP (SEQ ID NO: 4191) | 4 |

TABLE XXII

V25-HLA-A1-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 2 | RTPTRQISS (SEQ ID NO: 4192) | 10 |
| 1 | SRTPTRQIS (SEQ ID NO: 4193) | 7 |
| 4 | PTRQISSID (SEQ ID NO: 4194) | 6 |
| 9 | SSIDTDPPA (SEQ ID NO: 4195) | 6 |
| 5 | TRQISSIDT (SEQ ID NO: 4196) | 4 |
| 8 | ISSIDTDPP (SEQ ID NO: 4197) | 4 |

TABLE XXII

V25&26-HLA-A1-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 2 | PTRQISSSD (SEQ ID NO: 4198) | 6 |
| 7 | SSSDTDPPA (SEQ ID NO: 4199) | 6 |
| 6 | ISSSDTDPP (SEQ ID NO: 4200) | 4 |

TABLE XXII-continued

V25&26-HLA-A1-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | TPTRQISSS (SEQ ID NO: 4201) | 2 |

TABLE XXII

V26-HLA-A1-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 8 | SSDTDPPAD (SEQ ID NO: 4202) | 16 |
| 2 | PTRQIGSSD (SEQ ID NO: 4203) | 7 |

TABLE XXII

V27-HLA-A1-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | SRGQALRRA (SEQ ID NO: 4204) | 2 |
| 2 | RGQALRRAQ (SEQ ID NO: 4205) | 1 |

TABLE XXIII

V1-HLA-A0201-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 14 | ALQPGTALL (SEQ ID NO: 4206) | 30 |
| 108 | ALLPALGLL (SEQ ID NO: 4207) | 30 |

TABLE XXIII-continued

V1-HLA-A0201-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 105 | AILALLPAL (SEQ ID NO: 4208) | 29 |
| 5 | LLALLMAGL (SEQ ID NO: 4209) | 28 |
| 7 | ALLMAGLAL (SEQ ID NO: 4210) | 26 |
| 99 | ALQPAAAIL (SEQ ID NO: 4211) | 26 |
| 115 | LLLWGPGQL (SEQ ID NO: 4212) | 26 |
| 109 | LLPALGLLL (SEQ ID NO: 4213) | 24 |
| 53 | IRAVGLLTV (SEQ ID NO: 4214) | 23 |
| 8 | LLMAGLALQ (SEQ ID NO: 4215) | 21 |
| 20 | ALLCYSCKA (SEQ ID NO: 4216) | 21 |
| 107 | LALLPALGL (SEQ ID NO: 4217) | 21 |
| 13 | LALQPGTAL (SEQ ID NO: 4218) | 20 |
| 1 | MKAVLLALL (SEQ ID NO: 4219) | 19 |
| 4 | VLLALLMAG (SEQ ID NO: 4220) | 19 |
| 12 | GLALQPGTA (SEQ ID NO: 4221) | 19 |
| 54 | RAVGLLTVI (SEQ ID NO: 4222) | 19 |
| 57 | GLLTVISKG (SEQ ID NO: 4223) | 19 |
| 60 | TVISKGCSL (SEQ ID NO: 4224) | 19 |

TABLE XXIII-continued

V1-HLA-A0201-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 102 | PAAAILALL (SEQ ID NO: 4225) | 19 |
| 43 | QLGEQCWTA (SEQ ID NO: 4226) | 18 |
| 51 | ARIRAVGLL (SEQ ID NO: 4227) | 18 |
| 98 | HALQPAAAI (SEQ ID NO: 4228) | 18 |
| 101 | QPAAAILAL (SEQ ID NO: 4229) | 18 |
| 112 | ALGLLLWGP (SEQ ID NO: 4230) | 18 |
| 3 | AVLLALLMA (SEQ ID NO: 4231) | 17 |
| 50 | TARIRAVGL (SEQ ID NO: 4232) | 17 |
| 63 | SKGCSLNCV (SEQ ID NO: 4233) | 17 |
| 83 | NITCCDTDL (SEQ ID NO: 4234) | 17 |
| 104 | AAILALLPA (SEQ ID NO: 4235) | 17 |
| 106 | ILALLPALG (SEQ ID NO: 4236) | 17 |
| 9 | LMAGLALQP (SEQ ID NO: 4237) | 16 |
| 92 | CNASGAHAL (SEQ ID NO: 4238) | 16 |
| 22 | LCYSCKAQV (SEQ ID NO: 4239) | 15 |
| 30 | VSNEDCLQV (SEQ ID NO: 4240) | 15 |
| 67 | SLNCVDDSQ (SEQ ID NO: 4241) | 15 |

TABLE XXIII-continued

V1-HLA-A0201-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 114 | GLLLWGPGQ (SEQ ID NO: 4242) | 15 |
| 36 | LQVENCTQL (SEQ ID NO: 4243) | 14 |
| 48 | CWTARIRAV (SEQ ID NO: 4244) | 14 |
| 46 | SGDPASYRL (SEQ ID NO: 4245) | 15 |
| 127 | PADGPSNPL (SEQ ID NO: 4246) | 15 |
| 139 | FHGPAFSTL (SEQ ID NO: 4247) | 15 |
| 153 | HLFPQEAFP (SEQ ID NO: 4248) | 15 |
| 163 | HPIYDLSQV (SEQ ID NO: 4249) | 15 |
| 39 | SLHSACCSG (SEQ ID NO: 4250) | 14 |
| 51 | SYRLWGAPL (SEQ ID NO: 4251) | 14 |
| 53 | RLWGAPLQP (SEQ ID NO: 4252) | 14 |
| 61 | PTLGVVPQA (SEQ ID NO: 4253) | 14 |
| 70 | SVPLLTHPA (SEQ ID NO: 4254) | 14 |
| 83 | VLVPEAHPN (SEQ ID NO: 4255) | 14 |
| 86 | PEAHPNASL (SEQ ID NO: 4256) | 14 |
| 143 | AFSTLNPVL (SEQ ID NO: 4257) | 14 |
| 145 | STLNPVLRH (SEQ ID NO: 4258) | 14 |

TABLE XXIII-continued

V1-HLA-A0201-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 24 | AGPMPCSRL (SEQ ID NO: 4259) | 13 |
| 76 | HPAQWEPVL (SEQ ID NO: 4260) | 13 |
| 77 | PAQWEPVLV (SEQ ID NO: 4261) | 13 |
| 84 | LVPEAHPNA (SEQ ID NO: 4262) | 13 |
| 111 | LSRTPTRQI (SEQ ID NO: 4263) | 13 |
| 114 | TPTRQIGSI (SEQ ID NO: 4264) | 13 |
| 150 | VLRHLFPQE (SEQ ID NO: 4265) | 13 |
| 170 | QVWSWSPA (SEQ ID NO: 4266) | 13 |

TABLE XXIII

V4-HLA-A0201-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 146 | TLNPVLRHL (SEQ ID NO: 4267) | 27 |
| 35 | SLRCSLHSA (SEQ ID NO: 4268) | 23 |
| 58 | PLQPTLGVV (SEQ ID NO: 4269) | 23 |
| 166 | YDLSQVWSV (SEQ ID NO: 4270) | 20 |
| 57 | APLQPTLGV (SEQ ID NO: 4271) | 19 |
| 160 | FPAHPIYDL (SEQ ID NO: 4272) | 19 |

TABLE XXIII-continued

V4-HLA-A0201-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 167 | DLSQVWSVV (SEQ ID NO: 4273) | 19 |
| 55 | WGAPLQPTL (SEQ ID NO: 4274) | 18 |
| 94 | LTMYVCAPV (SEQ ID NO: 4275) | 18 |
| 63 | LGVVPQASV (SEQ ID NO: 4276) | 17 |
| 65 | VVPQASVPL (SEQ ID NO: 4277) | 17 |
| 93 | SLTMYVCAP (SEQ ID NO: 4278) | 17 |
| 142 | PAFSTLNPV (SEQ ID NO: 4279) | 17 |
| 31 | RLPPSLRCS (SEQ ID NO: 4280) | 16 |
| 66 | VPQASVPLL (SEQ ID NO: 4281) | 16 |
| 8 | WARRTSRAV (SEQ ID NO: 4282) | 15 |
| 32 | LPPSLRCSL (SEQ ID NO: 4283) | 15 |
| 46 | SGDPASYRL (SEQ ID NO: 4284) | 15 |
| 127 | PADGPSNPL (SEQ ID NO: 4285) | 15 |
| 139 | FHGPAFSTL (SEQ ID NO: 4286) | 15 |
| 153 | HLFPQEAFP (SEQ ID NO: 4287) | 15 |
| 163 | HPIYDLSQV (SEQ ID NO: 4288) | 15 |
| 39 | SLHSACCSG (SEQ ID NO: 4289) | 14 |

TABLE XXIII-continued

V4-HLA-A0201-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 51 | SYRLWGAPL (SEQ ID NO: 4290) | 14 |
| 53 | RLWGAPLQP (SEQ ID NO: 4291) | 14 |
| 61 | PTLGVVPQA (SEQ ID NO: 4292) | 14 |
| 70 | SVPLLTHPA (SEQ ID NO: 4293) | 14 |
| 83 | VLVPEAHPN (SEQ ID NO: 4294) | 14 |
| 86 | PEAHPNASL (SEQ ID NO: 4295) | 14 |
| 143 | AFSTLNPVL (SEQ ID NO: 4296) | 14 |
| 145 | STLNPVLRH (SEQ ID NO: 4297) | 14 |
| 24 | AGPMPCSRL (SEQ ID NO: 4298) | 13 |
| 76 | HPAQWEPVL (SEQ ID NO: 4299) | 13 |
| 77 | PAQWEPVLV (SEQ ID NO: 4300) | 13 |
| 84 | LVPEAHPNA (SEQ ID NO: 4301) | 13 |
| 111 | LSRTPTRQI (SEQ ID NO: 4302) | 13 |
| 114 | TPTRQIGSI (SEQ ID NO: 4303) | 13 |
| 150 | VLRHLFPQE (SEQ ID NO: 4304) | 13 |
| 170 | QVWSVVSPA (SEQ ID NO: 4305) | 13 |

TABLE XXIII

V19-HLA-A0201-9mers-PSCA
Each peptide is a portion of SEQ ID NO: 8;
each start position is specified, the
length of peptide is 9 amino acids, and
the end position for each peptide is the
start position plus eight.

| Pos | 123456789 | score |
|---|---|---|
| 8 | LLPSLRCSL (SEQ ID NO: 4306) | 25 |
| 7 | RLLPSLRCS (SEQ ID NO: 4307) | 18 |
| 4 | PCSRLLPSL (SEQ ID NO: 4308) | 15 |
| 1 | GPMPCSRLL (SEQ ID NO: 4309) | 14 |

TABLE XXIII

V20-HLA-A0201-9mers-PSCA
Each peptide is a portion of SEQ ID NO: 8;
each start position is specified, the
length of peptide is 9 amino acids, and
the end position for each peptide is the
start position plus eight.

| Pos | 123456789 | score |
|---|---|---|
| 3 | SGDPASSRL (SEQ ID NO: 4310) | 14 |
| 8 | SSRLWGAPL (SEQ ID NO: 4311) | 14 |
| 6 | PASSRLWGA (SEQ ID NO: 4312) | 10 |
| 9 | SRLWGAPLQ (SEQ ID NO: 4313) | 7 |
| 1 | CCSGDPASS (SEQ ID NO: 4314) | 6 |

TABLE XXIII

V21-HLA-A0201-9mers-PSCA
Each peptide is a portion of SEQ ID NO: 8; each
start position is specified, the length of peptide is 9
amino acids, and the end position for each peptide
is the start position plus eight.

| Pos | 123456789 | score |
|---|---|---|
| 3 | SVPLLTDPA (SEQ ID NO: 4315) | 13 |

TABLE XXIII-continued

V21-HLA-A0201-9mers-PSCA
Each peptide is a portion of SEQ ID NO: 8; each
start position is specified, the length of peptide is 9
amino acids, and the end position for each peptide
is the start position plus eight.

| Pos | 123456789 | score |
|---|---|---|
| 6 | LLTDPAQWE (SEQ ID NO: 4316) | 13 |
| 1 | QASVPLLTD (SEQ ID NO: 4317) | 12 |
| 9 | DPAQWEPVL (SEQ ID NO: 4318) | 12 |
| 5 | PLLTDEAQW (SEQ ID NO: 4319) | 11 |
| 7 | LTDPAQWEP (SEQ ID NO: 4320) | 10 |
| 8 | TDPAQWEPV (SEQ ID NO: 4321) | 10 |
| 2 | ASVPLLTDP (SEQ ID NO: 4322) | 9 |

TABLE XXIII

V21&22-HLA-A0201-9mers-PSCA
Each peptide is a portion of SEQ ID NO: 8; each
start position is specified, the length of peptide is 9
amino acids, and the end position for each peptide
is the start position plus eight.

| Pos | 123456789 | score |
|---|---|---|
| 8 | DLAQWEPVL (SEQ ID NO: 4323) | 22 |
| 1 | ASVPLLTDL (SEQ ID NO: 4324) | 19 |
| 4 | PLLTDLAQW (SEQ ID NO: 4325) | 15 |
| 2 | SVPLLTDLA (SEQ ID NO: 4326) | 13 |
| 5 | LLTDLAQWE (SEQ ID NO: 4327) | 13 |

TABLE XXIII-continued

V21&22-HLA-A0201-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 7 | TDLAQWEPV (SEQ ID NO: 4328) | 12 |

TABLE XXIII

V22-HLA-A0201-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 8 | HLAQWEPVL (SEQ ID NO: 4329) | 23 |
| 1 | ASVPLLTHL (SEQ ID NO: 4330) | 19 |
| 9 | LAQWEPVLV (SEQ ID NO: 4331) | 18 |
| 4 | PLLTHLAQW (SEQ ID NO: 4332) | 15 |
| 2 | SVPLLTHLA (SEQ ID NO: 4333) | 14 |
| 5 | LLTHLAQWE (SEQ ID NO: 4334) | 12 |
| 7 | THLAQWEPV (SEQ ID NO: 4335) | 12 |

TABLE XXIII

V24-HLA-A0201-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 2 | SLTMYVCTP (SEQ ID NO: 4336) | 18 |

TABLE XXIII-continued

V24-HLA-A0201-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | LTMYVCTPV (SEQ ID NO: 4337) | 16 |
| 4 | TMYVCTPVP (SEQ ID NO: 4338) | 12 |
| 6 | YVCTPVPHP (SEQ ID NO: 4339) | 12 |
| 1 | ASLTMYVCT (SEQ ID NO: 4340) | 10 |

TABLE XXIII

V25-HLA-A0201-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | TPTRQISSI (SEQ ID NO: 4341) | 13 |
| 9 | SSSDTDPPA (SEQ ID NO: 4342) | 10 |
| 6 | RQISSIDTD (SEQ ID NO: 4343) | 8 |
| 7 | QISSIDTDP (SEQ ID NO: 4344) | 8 |
| 2 | RTPTRQISS (SEQ ID NO: 4345) | 6 |

TABLE XXIII

V25&26-HLA-A0201-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 5 | QISSSDTDP (SEQ ID NO: 4346) | 8 |
| 7 | SSSDTQPPA (SEQ ID NO: 4347) | 8 |
| 1 | TPTRQISSS (SEQ ID NO: 4348) | 5 |
| 3 | TRQISSSDT (SEQ ID NO: 4349) | 4 |
| 4 | RQISSSDTD (SEQ ID NO: 4350) | 4 |
| 6 | ISSSDTDPP (SEQ ID NO: 4351) | 4 |
| 2 | PTRQISSSD (SEQ ID NO: 4352) | 3 |

TABLE XXIII

V26-HLA-A0201-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 5 | QIGSSDTDP (SEQ ID NO: 4353) | 8 |
| 7 | GSSDTDPPA (SEQ ID NO: 4354) | 7 |
| 3 | TRQIGSSDT (SEQ ID NO: 4355) | 6 |
| 4 | RQIGSSDTD (SEQ ID NO: 4356) | 6 |
| 1 | TPTRQIGSS (SEQ ID NO: 4357) | 5 |
| 9 | SDTDPPADG (SEQ ID NO: 4358) | 5 |
| 6 | IGSSDTDPP (SEQ ID NO: 4359) | 4 |
| 8 | SSDTDPPAD (SEQ ID NO: 4360) | 4 |
| 2 | PTRQIGSSD (SEQ ID NO: 4361) | 3 |

TABLE XXIII

V27-HLA-A0201-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | SRGQALRRA (SEQ ID NO: 4362) | 10 |

TABLE XXIV

V1-HLA-A0203-9mers-PSCA

| Pos | 123456789 | score |
|---|---|---|
| NoResultsFound. | | |

TABLE XXIV

V4-HLA-A0203-9mers-PSCA

| Pos | 123456789 | score |
|---|---|---|
| NoResultsFound. | | |

TABLE XXIV

V19-HLA-A0203-9mers-PSCA

| Pos | 123456789 | score |
|---|---|---|
| NoResultsFound. | | |

TABLE XXIV

V20-HLA-A0203-9mers-PSCA

| Pos | 123456789 | score |
|---|---|---|
| NoResultsFound. | | |

TABLE XXIV

V21-HLA-A0203-9mers-PSCA

| Pos | 123456789 | score |
|---|---|---|
| NoResultsFound. | | |

TABLE XXIV

V21&22-HLA-A0203-9mers-PSCA

| Pos | 123456789 | score |
|---|---|---|
| NoResultsFound. | | |

TABLE XXIV

V22-HLA-A0203-9mers-PSCA

| Pos | 123456789 | score |
|---|---|---|
| NoResultsFound. | | |

TABLE XXIV

V24-HLA-A0203-9mers-PSCA

| Pos | 123456789 | score |
|---|---|---|
| NoResultsFound. | | |

TABLE XXIV

V25-HLA-A0203-9mers-PSCA

| Pos | 123456789 | score |
|---|---|---|
| NoResultsFound. | | |

TABLE XXIV

V25&26-HLA-A0203-9mers-PSCA

| Pos | 123456789 | score |
|---|---|---|
| NoResultsFound. | | |

TABLE XXIV

V26-HLA-A0203-9mers-PSCA

| Pos | 123456789 | score |
|---|---|---|
| NoResultsFound. | | |

TABLE XXIV

V1-HLA-A3-9mers-PSCA

Each peptide is a portion of SEQ ID NO: 2; each start position is specified, the length of peptide is 9 amino acids, and the end position for each peptide is the start position plus eight.

| Pos | 123456789 | score |
|---|---|---|
| 52 | RIRAVGLLT (SEQ ID NO: 4363) | 24 |
| 7 | ALLMAGLAL (SEQ ID NO: 4364) | 22 |
| 99 | ALQPAAAIL (SEQ ID NO: 4365) | 22 |
| 14 | ALQPGTALL (SEQ ID NO: 4366) | 21 |
| 3 | AVLLALLMA (SEQ ID NO: 4367) | 20 |
| 60 | TVISKGCSL (SEQ ID NO: 4368) | 19 |
| 108 | ALLPALGLL (SEQ ID NO: 4369) | 19 |
| 115 | LLLWGPGQL (SEQ ID NO: 4370) | 19 |
| 12 | GLALQPGTA (SEQ ID NO: 4371) | 18 |
| 55 | AVGLLTVIS (SEQ ID NO: 4372) | 18 |
| 106 | ILALLPALG (SEQ ID NO: 4373) | 18 |
| 109 | LLPALGLLL (SEQ ID NO: 4374) | 18 |
| 8 | LLMAGLALQ (SEQ ID NO: 4375) | 17 |
| 43 | QLGEQCWTA (SEQ ID NO: 4376) | 17 |

TABLE XXIV-continued

V1-HLA-A3-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 70 | CVDDSQDYY (SEQ ID NO: 4377) | 17 |
| 90 | DLCNASGAH (SEQ ID NO: 4378) | 17 |
| 4 | VLLALLMAG (SEQ ID NO: 4379) | 16 |
| 19 | TALLCYSCK (SEQ ID NO: 4380) | 16 |
| 57 | GLLTVISKG (SEQ ID NO: 4381) | 16 |
| 105 | AILALLPAL (SEQ ID NO: 4382) | 16 |
| 114 | GLLLWGPGQ (SEQ ID NO: 4383) | 16 |
| 5 | LLALLMAGL (SEQ ID NO: 4384) | 15 |
| 20 | ALLCYSCKA (SEQ ID NO: 4385) | 15 |
| 56 | VGLLTVISK (SEQ ID NO: 4386) | 15 |
| 73 | DSQDYYVGK (SEQ ID NO: 4387) | 15 |
| 78 | YVGKKNITC (SEQ ID NO: 4388) | 15 |
| 35 | CLQVENCTQ (SEQ ID NO: 4389) | 14 |
| 67 | SLNCVDDSQ (SEQ ID NO: 4390) | 14 |
| 94 | ASGAHALQP (SEQ ID NO: 4391) | 14 |
| 112 | ALGLLLWGP (SEQ ID NO: 4392) | 14 |
| 29 | QVSNEDCLQ (SEQ ID NO: 4393) | 13 |

TABLE XXIV-continued

V1-HLA-A3-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 37 | QVENCTQLG (SEQ ID NO: 4394) | 13 |
| 50 | TARIRAVGL (SEQ ID NO: 4395) | 13 |
| 61 | VISKGCSLN (SEQ ID NO: 4396) | 13 |
| 9 | LMAGLALQP (SEQ ID NO: 4397) | 12 |
| 49 | WTARIRAVG (SEQ ID NO: 4398) | 12 |
| 53 | IRAVGLLTV (SEQ ID NO: 4399) | 12 |
| 74 | SQDYYVGKK (SEQ ID NO: 4400) | 12 |
| 16 | QPGTALLCY (SEQ ID NO: 4401) | 11 |
| 21 | LLCYSCKAQ (SEQ ID NO: 4402) | 11 |
| 54 | RAYGLLTVI (SEQ ID NO: 4403) | 11 |
| 103 | AAAILALLP (SEQ ID NO: 4404) | 11 |

TABLE XXV

V4-HLA-A3-9mers-PSCA
Each peptide is a portion of SEQ ID NO: 8; each start position is specified, the length of peptide is 9 amino acids, and the end position for each peptide is the start position plus eight

| Pos | 123456789 | score |
|---|---|---|
| 15 | AVTPTCATP (SEQ ID NO: 4405) | 23 |

TABLE XXV-continued

V4-HLA-A3-9mers-PSCA
Each peptide is a portion of SEQ ID NO: 8; each start position is specified, the length of peptide is 9 amino acids, and the end position for each peptide is the start position plus eight

| Pos | 123456789 | score |
|---|---|---|
| 53 | RLWGAPLQP (SEQ ID NO: 4406) | 23 |
| 64 | GVVPQASVP (SEQ ID NO: 4407) | 23 |
| 173 | SVVSPAPSR (SEQ ID NO: 4408) | 20 |
| 72 | PLLTHPAQW (SEQ ID NO: 4409) | 19 |
| 58 | PLQPTLGVV (SEQ ID NO: 4410) | 18 |
| 110 | ALSRTPTRQ (SEQ ID NO: 4411) | 18 |
| 167 | DLSQVWSVV (SEQ ID NO: 4412) | 18 |
| 10 | RRTSRATVP (SEQ ID NO: 4413) | 17 |
| 31 | RLPPSLRCS (SEQ ID NO: 4414) | 17 |
| 164 | PIYDLSQVS (SEQ ID NO: 4415) | 17 |
| 174 | VVSPAPSRG (SEQ ID NO: 4416) | 17 |
| 35 | SLRCSLHSA (SEQ ID NO: 4417) | 16 |
| 83 | VLVPEAHPN (SEQ ID NO: 4418) | 16 |
| 150 | VLRHLFPQE (SEQ ID NO: 4419) | 16 |
| 153 | HLFPQEAFP (SEQ ID NO: 4420) | 16 |
| 170 | QVWSVVSPA (SEQ ID NO: 4421) | 16 |

TABLE XXV-continued

V4-HLA-A3-9mers-PSCA
Each peptide is a portion of SEQ ID NO: 8; each start position is specified, the length of peptide is 9 amino acids, and the end position for each peptide is the start position plus eight

| Pos | 123456789 | score |
|---|---|---|
| 82 | PVLVPEAHP (SEQ ID NO: 4422) | 15 |
| 105 | PDPPMALSR (SEQ ID NO: 4423) | 15 |
| 149 | PVLRHLFPQ (SEQ ID NO: 4424) | 15 |
| 178 | APSRGQALR (SEQ ID NO: 4425) | 15 |
| 179 | PSRGQALRR (SEQ ID NO: 4426) | 15 |
| 9 | ARRTSRAVT (SEQ ID NO: 4427) | 14 |
| 44 | CCSGDPASY (SEQ ID NO: 4428) | 14 |
| 65 | VVPQASVPL (SEQ ID NO: 4429) | 14 |
| 73 | LLTHPAQWE (SEQ ID NO: 4430) | 14 |
| 146 | TLNPVLRHL (SEQ ID NO: 4431) | 14 |
| 39 | SLHSACCSG (SEQ ID NO: 4432) | 13 |
| 62 | TLGVVPQAS (SEQ ID NO: 4433) | 13 |
| 68 | QASVPLLTH (SEQ ID NO: 4434) | 13 |
| 117 | RQIGSIDTD (SEQ ID NO: 4435) | 13 |
| 6 | TTWARRTSR (SEQ ID NO: 4436) | 12 |
| 29 | CSRLPPSLR (SEQ ID NO: 4437) | 12 |

TABLE XXV-continued

V4-HLA-A3-9mers-PSCA
Each peptide is a portion of SEQ ID NO: 8; each start position is specified, the length of peptide is 9 amino acids, and the end position for each peptide is the start position plus eight

| Pos | 123456789 | score |
|---|---|---|
| 50 | ASYRLWGAP (SEQ ID NO: 4438) | 12 |
| 70 | SVELLIHPA (SEQ ID NO: 4439) | 12 |
| 93 | SLTMYVCAP (SEQ ID NO: 4440) | 12 |
| 97 | YVCAPMRHP (SEQ ID NO: 4441) | 12 |
| 109 | MALSRIETR (SEQ ID NO: 4442) | 12 |
| 181 | RGQALRRAR (SEQ ID NO: 4443) | 12 |
| 45 | CSGDPASYR (SEQ ID NO: 4444) | 11 |
| 51 | SYRLWGAPL (SEQ ID NO: 4445) | 11 |
| 59 | LQPTLGVVP (SEQ ID NO: 4446) | 11 |
| 78 | AQWEPVLVP (SEQ ID NO: 4447) | 11 |
| 84 | LVPEAHPNA (SEQ ID NO: 4448) | 11 |
| 88 | AHPNASLTM (SEQ ID NO: 4449) | 11 |
| 95 | TMYVCAPVP (SEQ ID NO: 4450) | 11 |
| 118 | QIGSIDTDP (SEQ ID NO: 4451) | 11 |
| 121 | SIDTDPPAD (SEQ ID NO: 4452) | 11 |
| 145 | STLNPVLRH (SEQ ID NO: 4453) | 11 |

TABLE XXV-continued

V4-HLA-A3-9mers-PSCA
Each peptide is a portion of SEQ ID NO: 8; each start position is specified, the length of peptide is 9 amino acids, and the end position for each peptide is the start position plus eight

| Pos | 123456789 | score |
|---|---|---|
| 152 | RHLFPQEAF (SEQ ID NO: 4454) | 11 |

TABLE XXV

V19-HLA-A3-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 7 | RLLPSLRCS (SEQ ID NO: 4455) | 19 |
| 8 | LLPSLRCSL (SEQ ID NO: 4456) | 13 |
| 5 | CSRLLPSLR (SEQ ID NO: 4457) | 12 |
| 9 | LPSLRCSLH (SEQ ID NO: 4458) | 10 |

TABLE XXV

V20-HLA-A3-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 2 | CSGDPASSR (SEQ ID NO: 4459) | 13 |
| 8 | SSRLWGAPL (SEQ ID NO: 4460) | 11 |
| 1 | CCSGDPASS (SEQ ID NO: 4461) | 8 |

TABLE XXV-continued

V20-HLA-A3-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 7 | ASSRLWGAP (SEQ ID NO: 4462) | 8 |
| 9 | SRLWGAELQ (SEQ ID NO: 4463) | 8 |
| 3 | SGDPASSRL (SEQ ID NO: 4464) | 7 |
| 5 | DPASSRLWG (SEQ ID NO: 4465) | 13 |

TABLE XXV

V21-HLA-A3-9mers-PSCA
Each peptide is a portion of SEQ ID NO: 8; each start position is specified, the length of pepfide is 9 amino acids, and the end position for each peptide is the start position plus eight.

| Pos | 123456789 | score |
|---|---|---|
| 5 | PLLTDPAQW (SEQ ID NO: 4466) | 19 |
| 6 | LLTDPAQWE (SEQ ID NO: 4467) | 15 |
| 3 | SVPLLTDPA (SEQ ID NO: 4468) | 12 |
| 1 | QASVPLLTD (SEQ ID NO: 4469) | 9 |

TABLE XXV

V21&22-HLA-A3-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 4 | PLLTDLAQW (SEQ ID NO: 4470) | 18 |

TABLE XXV-continued

V21&22-HLA-A3-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 5 | LLTDLAQWE (SEQ ID NO: 4471) | 15 |
| 8 | DLAQWEPVL (SEQ ID NO: 4472) | 15 |
| 2 | SVPLLTDLA (SEQ ID NO: 4473) | 12 |

TABLE XXV

V22-HLA-A3-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 4 | PLLTHLAQW (SEQ ID NO: 4474) | 18 |
| 8 | HLAQWEPVL (SEQ ID NO: 4475) | 15 |
| 5 | LLTHLAQWE (SEQ ID NO: 4476) | 14 |
| 2 | SVPLLIHLA (SEQ ID NO: 4477) | 12 |

TABLE XXV

V24-HLA-A3-9mers-PSCA
Each peptide is a portion of SEQ ID NO: 8; each start position is specified, the lenght of peptide is 9 amino acids, and the end position for each peptide is the start position plus eight.

| Pos | 123456789 | score |
|---|---|---|
| 2 | SLTMYVCTP (SEQ ID NO: 4478) | 15 |

TABLE XXV-continued

V24-HLA-A3-9mers-PSCA
Each peptide is a portion of SEQ ID NO: 8; each start position is specified, the lenght of peptide is 9 amino acids, and the end position for each peptide is the start position plus eight.

| Pos | 123456789 | score |
|---|---|---|
| 6 | YVCTPVPHP (SEQ ID NO: 4479) | 10 |
| 1 | ASLTMYVCT (SEQ ID NO: 4480) | 9 |
| 5 | MYVCTPVPH (SEQ ID NO: 4481) | 9 |
| 4 | TMYVCTPVP (SEQ ID NO: 4482) | 8 |

TABLE XXV

V25-HLA-A3-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 6 | RQISSIDTD (SEQ ID NO: 4483) | 11 |
| 7 | QISSIDTDP (SEQ ID NO: 4484) | 11 |
| 2 | RTPTRQISS (SEQ ID NO: 4485) | 8 |
| 3 | TPTRQISSI (SEQ ID NO: 4486) | 8 |
| 4 | PTRQISSID (SEQ ID NO: 4487) | 6 |
| 1 | SRTPTRQIS (SEQ ID NO: 4488) | 5 |
| 9 | SSIDTDPPA (SEQ ID NO: 4489) | 5 |

TABLE XXV

V25&26-HLA-A3-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 4 | RQISSSDTD (SEQ ID NO: 4490) | 11 |
| 5 | QISSSDTDP (SEQ ID NO: 4491) | 11 |
| 1 | TPTRQISSS (SEQ ID NO: 4492) | 8 |
| 2 | PTRQISSSD (SEQ ID NO: 4493) | 8 |

TABLE XXV

V26-HLA-A3-9mers-PSCA
Each peptide is a portion of SEQ ID NO: 8; each start position is specified, the length of peptide is 9 amino acids, and the end position for each peptide is the start position plus eight

| Pos | 123456789 | score |
|---|---|---|
| 4 | RQIGSSDTD (SEQ ID NO: 4494) | 13 |
| 2 | PTRQIGSSD (SEQ ID NO: 4495) | 11 |
| 5 | QIGSSDTDP (SEQ ID NO: 4496) | 11 |
| 1 | TPTRQIGSS (SEQ ID NO: 4497) | 6 |
| 3 | TRQIGSSDT (SEQ ID NO: 4498) | 6 |
| 9 | SDTDPEADG (SEQ ID NO: 4499) | 6 |

TABLE XXV

V27-HLA-A3-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 2 | RGQALRRAQ (SEQ ID NO: 4500) | 8 |

TABLE XXVi

V1-HLA-A26-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 60 | TVISKGCSL (SEQ ID NO: 4501) | 27 |
| 70 | CVDDSQDYY (SEQ ID NO: 4502) | 21 |
| 105 | AILALLPAL (SEQ ID NO: 4503) | 18 |
| 51 | ARIRAVGLL (SEQ ID NO: 4504) | 17 |
| 88 | DTDLCNASG (SEQ ID NO: 4505) | 17 |
| 3 | AVLLALLMA (SEQ ID NO: 4506) | 16 |
| 36 | LQVENCTQL (SEQ ID NO: 4507) | 16 |
| 16 | QPGTALLCY (SEQ ID NO: 4508) | 15 |
| 39 | ENCTQLGEQ (SEQ ID NO: 4509) | 15 |
| 69 | NCVDDSQDY (SEQ ID NO: 4510) | 15 |
| 28 | AQVSNEDCL (SEQ ID NO: 4511) | 14 |

TABLE XXVi-continued

V1-HLA-A26-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 33 | EDCLQVENC (SEQ ID NO: 4512) | 14 |
| 101 | QPAAAILAL (SEQ ID NO: 4513) | 14 |
| 102 | PAAAILALL (SEQ ID NO: 4514) | 14 |
| 108 | ALLPALGLL (SEQ ID NO: 4515) | 14 |
| 1 | MKAVLLALL (SEQ ID NO: 4516) | 13 |
| 59 | LTVISKGCS (SEQ ID NO: 4517) | 13 |
| 78 | YVGKKNITC (SEQ ID NO: 4518) | 13 |
| 83 | NITDCDTDL (SEQ ID NO: 4519) | 13 |

TABLE XXVi

V4-HLA-A26-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 158 | EAFPAHPIY (SEQ ID NO: 4520) | 25 |
| 65 | VVPQASVPL (SEQ ID NO: 4521) | 18 |
| 123 | DTDPPADGP (SEQ ID NO: 4522) | 17 |
| 173 | SVVSPAPSR (SEQ ID NO: 4523) | 17 |

TABLE XXVi-continued

V4-HLA-A26-9mers-PSCA
Each peptide is a portion
of SEQ ID NO: 8; each
start position is specified,
the length of peptide is 9
amino acids, and the end
position for each peptide
is the start position plus
eight.

| Pos | 123456789 | score |
|---|---|---|
| 64 | GVVPQASVP (SEQ ID NO: 4524) | 16 |
| 170 | QVWSVVSPA (SEQ ID NO: 4525) | 16 |
| 81 | EPVLVPEAH (SEQ ID NO: 4526) | 15 |
| 89 | HPNASLTMY (SEQ ID NO: 4527) | 15 |
| 97 | YVCAPVPHP (SEQ ID NO: 4528) | 14 |
| 145 | STLNPVLRH (SEQ ID NO: 4529) | 14 |
| 146 | TLNPVLRHL (SEQ ID NO: 4530) | 14 |
| 149 | PVLRHLFPQ (SEQ ID NO: 4531) | 14 |
| 15 | AVTPTCATP (SEQ ID NO: 4532) | 13 |
| 61 | PTLGVVPQA (SEQ ID NO: 4533) | 13 |
| 87 | EAHPNASLT (SEQ ID NO: 4534) | 13 |
| 106 | DPPMALSRT (SEQ ID NO: 4535) | 13 |
| 11 | RTSRAVTPT (SEQ ID NO: 4536) | 12 |
| 66 | VPQASVPLL (SEQ ID NO: 4537) | 12 |
| 70 | SVPLLTHPA (SEQ ID NO: 4538) | 12 |
| 84 | LVPEAHPNA (SEQ ID NO: 4539) | 12 |

TABLE XXVi-continued

V4-HLA-A26-9mers-PSCA
Each peptide is a portion
of SEQ ID NO: 8; each
start position is specified,
the length of peptide is 9
amino acids, and the end
position for each peptide
is the start position plus
eight.

| Pos | 123456789 | score |
|---|---|---|
| 115 | PRTQIGSID (SEQ ID NO: 4540) | 12 |
| 160 | FPAHPIYDL (SEQ ID NO: 4541) | 12 |
| 174 | VVSPAPSRG (SEQ ID NO: 4542) | 12 |

TABLE XXVi

V19-HLA-A26-9mers-PSCA
Each peptide is a portion
of SEQ ID NO: 8; each
start position is specified,
the length of peptide is 9
amino acids, and the end
position for each peptide
is the start position plus
eight.

| Pos | 123456789 | score |
|---|---|---|
| 4 | PCSRLLPSL (SEQ ID NO: 4543) | 14 |
| 8 | LLPSLRCSL (SEQ ID NO: 4544) | 11 |
| 1 | GPMPCSRLL (SEQ ID NO: 4545) | 9 |
| 3 | MPCSRLLPS (SEQ ID NO: 4546) | 6 |

TABLE XXVi

V20-HLA-A26-9mers-PSCA
Each peptide is a portion of SEQ ID NO: 8; each
start position is specified, the length of
peptide is 9 amino acids, and the end position
for each peptide is the start position plus eight.

| Pos | 123456789 | score |
|---|---|---|
| 3 | SGDPASSRL (SEQ ID NO: 4547) | 11 |
| 5 | DPASSRLWG (SEQ ID NO: 4548) | 10 |

TABLE XXVi-continued

V20-HLA-A26-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 8 | SSRLWGAPL (SEQ ID NO: 4549) | 10 |
| 6 | PASSRLWGA (SEQ ID NO: 4550) | 5 |

TABLE XXVi

V21-HLA-A26-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 9 | DPAQWEPVL (SEQ ID NO: 4551) | 16 |
| 3 | SVPLLTDPA (SEQ ID NO: 4552) | 12 |
| 2 | ASVPLLTDP (SEQ ID NO: 4553) | 10 |
| 7 | LTDPAQWEP (SEQ ID NO: 4554) | 9 |

TABLE XXVi

V21&22-HLA-A26-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | ASVPLLTDL (SEQ ID NO: 4555) | 18 |
| 8 | DLAQWEPVL (SEQ ID NO: 4556) | 16 |
| 2 | SVPLLTDLA (SEQ ID NO: 4557) | 12 |
| 6 | LTDLAQWEP (SEQ ID NO: 4558) | 8 |

TABLE XXVi

V22-HLA-A26-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | ASVPLLTHL (SEQ ID NO: 4559) | 18 |
| 2 | SVPLLTHLA (SEQ ID NO: 4560) | 12 |
| 6 | LTHLAQWEP (SEQ ID NO: 4561) | 8 |
| 8 | HLAQWEPVL (SEQ ID NO: 4562) | 8 |

TABLE XXVi

V24-HLA-A26-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 6 | YVCTPVPHP (SEQ ID NO: 4563) | 14 |
| 3 | LTMYVCTPV (SEQ ID NO: 4564) | 8 |
| 8 | CTPVPHPDP (SEQ ID NO: 4565) | 8 |
| 2 | SLTMYVCTP (SEQ ID NO: 4566) | 7 |

TABLE XXVi

V25-HLA-A26-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 4 | PTRQISSID (SEQ ID NO: 4567) | 11 |
| 2 | RTPTRQISS (SEQ ID NO: 4568) | 10 |
| 6 | RQISSIDTD (SEQ ID NO: 4569) | 10 |

TABLE XXVi-continued

V25-HLA-A26-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | TPTRQISSI (SEQ ID NO: 4570) | 8 |
| 7 | QISSIDTDP (SEQ ID NO: 4571) | 7 |
| 9 | SSIDTDPPA (SEQ ID NO: 4572) | 6 |

TABLE XXVi

V25&26-HLA-A26-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 2 | PTRQISSSD (SEQ ID NO: 4573) | 12 |
| 1 | TPTRQISSS (SEQ ID NO: 4574) | 8 |
| 4 | RQISSSDTD (SEQ ID NO: 4575) | 6 |
| 5 | QISSSDTDP (SEQ ID NO: 4576) | 5 |

TABLE XXVi

V26-HLA-A26-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 2 | PTRQIGSSD (SEQ ID NO: 4577) | 13 |
| 1 | TPTRQIGSS (SEQ ID NO: 4578) | 8 |

TABLE XXVi

V27-HLA-A26-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | SRGQALRRA (SEQ ID NO: 4579) | 5 |

TABLE XXVII

V1-HLA-B0702-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 101 | QPAAAILAL (SEQ ID NO: 4580) | 25 |
| 7 | ALLMAGLAL (SEQ ID NO: 4581) | 16 |
| 13 | LALQPGTAL (SEQ ID NO: 4582) | 16 |
| 14 | ALQPGTALL (SEQ ID NO: 4583) | 15 |
| 105 | AILALLPAL (SEQ ID NO: 4584) | 15 |
| 107 | LALLPALGL (SEQ ID NO: 4585) | 15 |
| 50 | TARIRAVGL (SEQ ID NO: 4586) | 14 |
| 99 | ALQPAAAIL (SEQ ID NO: 4587) | 14 |
| 109 | LLPALGLLL (SEQ ID NO: 4588) | 14 |
| 16 | QPGTALLCY (SEQ ID NO: 4589) | 13 |
| 51 | ARIRAVGLL (SEQ ID NO: 4590) | 13 |
| 52 | RIRAVGLLT (SEQ ID NO: 4591) | 13 |
| 102 | PAAAILALL (SEQ ID NO: 4592) | 13 |

TABLE XXVII-continued

V1-HLA-B0702-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 108 | ALLPALGLL (SEQ ID NO: 4593) | 13 |
| 110 | LPALGLLLW (SEQ ID NO: 4594) | 13 |
| 1 | MKAVLLALL (SEQ ID NO: 4595) | 12 |
| 5 | LLALLMAGL (SEQ ID NO: 4596) | 12 |
| 28 | AQVSNEDCL (SEQ ID NO: 4597) | 12 |
| 92 | CNASGAHAL (SEQ ID NO: 4598) | 12 |

TABLE XXVII

V4-HLA-B0702-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 57 | APLQPTLGV (SEQ ID NO: 4599) | 24 |
| 160 | FPAHPIYDL (SEQ ID NO: 4600) | 24 |
| 66 | VPQASVPLL (SEQ ID NO: 4601) | 23 |
| 76 | HPAQWEPVL (SEQ ID NO: 4602) | 23 |
| 32 | LPPSLRCSL (SEQ ID NO: 4603) | 21 |
| 76 | SPAPSRGQA (SEQ ID NO: 4604) | 19 |
| 102 | VPHPDPPMA (SEQ ID NO: 4605) | 18 |

TABLE XXVII-continued

V4-HLA-B0702-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 22 | TPAGPMPCS (SEQ ID NO: 4606) | 17 |
| 127 | PADGPSNPL (SEQ ID NO: 4607) | 17 |
| 104 | HPDPPMALS (SEQ ID NO: 4608) | 16 |
| 106 | DPPMALSRT (SEQ ID NO: 4609) | 16 |
| 114 | TPTRQIGSI (SEQ ID NO: 4610) | 16 |
| 143 | AFSTLNPVL (SEQ ID NO: 4611) | 16 |
| 163 | HPIYDLSQV (SEQ ID NO: 4612) | 16 |
| 24 | AGPMPCSRL (SEQ ID NO: 4613) | 15 |
| 51 | SYRLWGAPL (SEQ ID NO: 4614) | 15 |
| 86 | PEAHPNASL (SEQ ID NO: 4615) | 15 |
| 130 | GPSNPLCCC (SEQ ID NO: 4616) | 15 |
| 178 | APSRGQALR (SEQ ID NO: 4617) | 15 |
| 48 | DPASYRLWG (SEQ ID NO: 4618) | 14 |
| 60 | QPTLGVVPQ (SEQ ID NO: 4619) | 14 |
| 100 | APVPHPDPP (SEQ ID NO: 4620) | 14 |
| 103 | PHPOPPMAL (SEQ ID NO: 4621) | 14 |

TABLE XXVII-continued

V4-HLA-B0702-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 141 | GPAFSTLNP (SEQ ID NO: 4622) | 14 |
| 9 | ARRTSRAVT (SEQ ID NO: 4623) | 13 |
| 17 | TPTCATPAG (SEQ ID NO: 4624) | 13 |
| 28 | PCSRLPPSL (SEQ ID NO: 4625) | 13 |
| 55 | WGAPLQPTL (SEQ ID NO: 4626) | 13 |
| 65 | VVPQASVPL (SEQ ID NO: 4627) | 13 |
| 125 | DPPADGPSN (SEQ ID NO: 4628) | 13 |
| 139 | FHGPAFSTL (SEQ ID NO: 4629) | 13 |
| 148 | NPVLRHLFP (SEQ ID NO: 4630) | 13 |
| 155 | FPQEAFPAH (SEQ ID NO: 4631) | 13 |
| 11 | RTSRAVTPT (SEQ ID NO: 4632) | 12 |
| 14 | RAVTPTCAT (SEQ ID NO: 4633) | 12 |
| 25 | GPMPCSRLP (SEQ ID NO: 4634) | 12 |
| 27 | MPCSRLPPS (SEQ ID NO: 4635) | 12 |
| 33 | PPSLRCSLH (SEQ ID NO: 4636) | 12 |
| 46 | SGDPASYRL (SEQ ID NO: 4637) | 12 |
| 54 | LWGAPLQPT (SEQ ID NO: 4638) | 12 |
| 71 | VPLLTHPAQ (SEQ ID NO: 4639) | 12 |
| 81 | EPVLVPEAH (SEQ ID NO: 4640) | 12 |
| 85 | VPEAHPNAS (SEQ ID NO: 4641) | 12 |
| 89 | HPNASLTMY (SEQ ID NO: 4642) | 12 |
| 107 | PPMALSRTP (SEQ ID NO: 4643) | 12 |
| 111 | LSRTPTRQI (SEQ ID NO: 4644) | 12 |
| 177 | PAPSRGQAL (SEQ ID NO: 4645) | 12 |
| 19 | TCATPAGPM (SEQ ID NO: 4646) | 11 |
| 101 | PVPHPDPPM (SEQ ID NO: 4647) | 11 |
| 126 | PPADGPSNP (SEQ ID NO: 4648) | 11 |
| 138 | CFHGPAFST (SEQ ID NO: 4649) | 11 |
| 146 | TLNPVLRHL (SEQ ID NO: 4650) | 11 |
| 152 | RHLFPQEAF (SEQ ID NO: 4651) | 11 |
| 157 | QEAFPAHPI (SEQ ID NO: 4652) | 11 |

TABLE XXVII

V19-HLA-B0702-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | GPMPCSRLL (SEQ ID NO: 4653) | 22 |
| 3 | MPCSRLLPS (SEQ ID NO: 4654) | 13 |
| 4 | PCSRLLPSL (SEQ ID NO: 4655) | 13 |
| 9 | LPSLRCSLH (SEQ ID NO: 4656) | 12 |
| 8 | LLPSLRCSL (SEQ ID NO: 4657) | 11 |

TABLE XXVII

V20-HLA-B0702-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 8 | SSRLWGAPL (SEQ ID NO: 4658) | 15 |
| 5 | DPASSRLWG (SEQ ID NO: 4659) | 14 |
| 3 | SGDPASSRL (SEQ ID NO: 4660) | 12 |
| 6 | PASSRLWGA (SEQ ID NO: 4661) | 8 |

TABLE XXVII

V21-HLA-B0702-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 9 | DPAQWEPVL (SEQ ID NO: 4662) | 23 |
| 4 | VPLLTDPAQ (SEQ ID NO: 4663) | 12 |

TABLE XXVII

V21&22-HLA-B0702-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | ASVPLLTDL (SEQ ID NO: 4664) | 14 |
| 3 | VPLLTDLAQ (SEQ ID NO: 4665) | 13 |
| 8 | DLAQWEPVL (SEQ ID NO: 4666) | 13 |
| 7 | TDLAQWEPV (SEQ ID NO: 4667) | 8 |
| 2 | SVPLLTDLA (SEQ ID NO: 4668) | 7 |

TABLE XXVII

V22-HLA-B0702-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | ASVPLLTHL (SEQ ID NO: 4669) | 14 |
| 3 | VPLLTHLAQ (SEQ ID NO: 4670) | 13 |
| 8 | HLAQWEPVL (SEQ ID NO: 4671) | 13 |
| 7 | THLAQWEPV (SEQ ID NO: 4672) | 8 |
| 9 | LAQWEPVLV (SEQ ID NO: 4673) | 8 |
| 2 | SVPLLTHLA (SEQ ID NO: 4674) | 7 |

TABLE XXVII

V24-HLA-B0702-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | ASLTMYVCT (SEQ ID NO: 4675) | 10 |
| 3 | LTMYVCTPV (SEQ ID NO: 4676) | 9 |
| 6 | YVCTPVPHP (SEQ ID NO: 4677) | 5 |
| 8 | CTPVPHPDP (SEQ ID NO: 4678) | 4 |

TABLE XXVII

V25-HLA-B0702-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | TPTRQISSI (SEQ ID NO: 4679) | 16 |
| 9 | SSIDTDPPA (SEQ ID NO: 4680) | 8 |

TABLE XXVII

V25&26-B0702-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | TPTRQISSS (SEQ ID NO: 4681) | 10 |
| 7 | SSSDTDPPA (SEQ ID NO: 4682) | 10 |

TABLE XXVII-continued

V25&26-B0702-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | TRQOSSSDT (SEQ ID NO: 4683) | 6 |
| 6 | ISSSDTDPP (SEQ ID NO: 4684) | 5 |

TABLE XXVII

V26-HLA-B0702-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | TPTRQIGSS (SEQ ID NO: 4685) | 10 |
| 7 | GSSDTDPPA (SEQ ID NO: 4686) | 10 |
| 3 | TRQIGSSDT (SEQ ID NO: 4687) | 6 |
| 6 | IGSSDTDPP (SEQ ID NO: 4688) | 5 |
| 9 | SDTDPPADG (SEQ ID NO: 4689) | 4 |

TABLE XXVII

V27-HLA-B0702-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | SRGQALRRA (SEQ ID NO: 4690) | 7 |

TABLE XXVIII

V1-HLA-B08-9mers-PSCA
Each peptide is a portion of SEQ ID NO: 2; each start position is specified, the length of peptide is 9 amino acids, and the end position for each peptide is the start position plus eight.

| Posi | 123456789 | score |
|---|---|---|
| 50 | TARIRAVGL (SEQ ID NO: 4691) | 29 |
| 60 | TVISKGCSL (SEQ ID NO: 4692) | 20 |
| 101 | QPAAAILAL (SEQ ID NO: 4693) | 18 |
| 5 | LLALLMAGL (SEQ ID NO: 4694) | 17 |
| 7 | ALLMAGLAL (SEQ ID NO: 4695) | 17 |
| 14 | ALQPGTALL (SEQ ID NO: 4696) | 16 |
| 99 | ALQPAAAIL (SEQ ID NO: 4697) | 16 |
| 108 | ALLPALGLL (SEQ ID NO: 4698) | 16 |
| 109 | LLPALGLLL (SEQ ID NO: 4699) | 16 |
| 115 | LLLWGPGQL (SEQ ID NO: 4700) | 16 |
| 13 | LALQPGTAL (SEQ ID NO: 4701) | 15 |
| 105 | AILALLPAL (SEQ ID NO: 4702) | 15 |
| 107 | LALLPALGL (SEQ ID NO: 4703) | 15 |
| 83 | NITCCDTDL (SEQ ID NO: 4704) | 14 |
| 102 | PAAAILALL (SEQ ID NO: 4705) | 14 |

TABLE XXVIII

V4-HLA-B08-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 177 | PAPSRGQAL (SEQ ID NO: 4706) | 23 |
| 51 | SYRLWGAPL (SEQ ID NO: 4707) | 19 |
| 66 | VPQASVPLL (SEQ ID NO: 4708) | 18 |
| 160 | FPAHPIYDL (SEQ ID NO: 4709) | 18 |
| 76 | HPAQWEPVL (SEQ ID NO: 4710) | 17 |
| 32 | LPPSLRCSL (SEQ ID NO: 4711) | 16 |
| 146 | TLNPVLRHL (SEQ ID NO: 4712) | 16 |
| 33 | PPSLRCSLH (SEQ ID NO: 4713) | 15 |
| 148 | NPVLRHLFP (SEQ ID NO: 4714) | 15 |
| 27 | MPCSRLPPS (SEQ ID NO: 4715) | 14 |
| 35 | SLRCSLHSA (SEQ ID NO: 4716) | 14 |
| 127 | PADGPSNPL (SEQ ID NO: 4717) | 14 |
| 49 | PASYRLWGA (SEQ ID NO: 4718) | 13 |
| 114 | TPTRQIGSI (SEQ ID NO: 4719) | 13 |
| 150 | VLRHLFPQE (SEQ ID NO: 4720) | 13 |
| 46 | SGDPASYRL (SEQ ID NO: 4721) | 12 |
| 65 | VVPQASVPL (SEQ ID NO: 4722) | 12 |

TABLE XXVIII-continued

V4-HLA-B08-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 109 | MALSRTPTR (SEQ ID NO: 4723) | 12 |
| 111 | LSRTPTRQI (SEQ ID NO: 4724) | 12 |
| 8 | WARRTSRAV (SEQ ID NO: 4725) | 11 |
| 86 | PEAHPNASL (SEQ ID NO: 4726) | 11 |
| 103 | PHPDPPMAL (SEQ ID NO: 4727) | 11 |
| 139 | FHGPAFSTL (SEQ ID NO: 4728) | 11 |
| 143 | AFSTLNPVL (SEQ ID NO: 4729) | 11 |

TABLE XXVIII

V19-HLA-B08-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | GPMPCSRLL (SEQ ID NO: 4730) | 17 |
| 8 | LLPSLRCSL (SEQ ID NO: 4731) | 16 |
| 9 | LPSLRSCLH (SEQ ID NO: 4732) | 15 |
| 3 | MPCSRLLPS (SEQ ID NO: 4733) | 14 |
| 4 | PCSRLLPSL (SEQ ID NO: 4734) | 10 |

TABLE XXVIII

V20-HLA-B08-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 8 | SSRLWGAPL (SEQ ID NO: 4735) | 19 |
| 3 | SGDPASSRL (SEQ ID NO: 4736) | 12 |
| 6 | PASSRLWGA (SEQ ID NO: 4737) | 12 |

TABLE XXVIII

V21-HLA-B08-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 9 | DPAQWEPVL (SEQ ID NO: 4738) | 16 |
| 4 | VPLLTDPAQ (SEQ ID NO: 4739) | 9 |

TABLE XXVIII

V21&22-HLA-B08-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 8 | DLAQWEPVL (SEQ ID NO: 4740) | 16 |
| 1 | ASVPLLTDL (SEQ ID NO: 4741) | 10 |
| 3 | VPLLTDLAQ (SEQ ID NO: 4742) | 9 |

TABLE XXVIII

V22-HLA-B08-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 8 | HLAQWEPVL (SEQ ID NO: 4743) | 17 |

TABLE XXVIII-continued

V22-HLA-B08-9mers-PSCA

Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | ASVPLLTHL (SEQ ID NO: 4744) | 10 |
| 3 | VPLLTHLAQ (SEQ ID NO: 4745) | 9 |

TABLE XXVIII

V24-HLA-B08-9mers-PSCA

Each peptide is a portion of SEQ ID NO: 8; each start position is specified, the length of peptide is 9 amino acids, and the end position for each peptide is the start position plus eight.

| Pos | 123456789 | score |
|---|---|---|
| 2 | SLTMYVCTP (SEQ ID NO: 4746) | 9 |

TABLE XXVIII

V25-HLA-B08-9mers-PSCA

Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | TPTRQISSI (SEQ ID NO: 4747) | 13 |
| 2 | RTPTRQISS (SEQ ID NO: 4748) | 8 |
| 4 | PTRQISSID (SEQ ID NO: 4749) | 6 |

TABLE XXVIII

V25&26-HLA-B08-9mers-PSCA

Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | TPTRQISSS (SEQ ID NO: 4750) | 7 |
| 2 | PTRQISSSD (SEQ ID NO: 4751) | 6 |

TABLE XXVIII-continued

V25&26-HLA-B08-9mers-PSCA

Each peptide is a portion of SEQ ID NO: 8; each start position is specified, the length of peptide is 9 amino acids, and the end position for each peptide is the start position plus eight.

| Pos | 123456789 | score |
|---|---|---|
| 5 | QISSSDTDP (SEQ ID NO: 4752) | 4 |

TABLE XXVIII

V26-HLA-B08-9mers-PSCA

Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | TPTRQIGSS (SEQ ID NO: 4753) | 7 |
| 2 | PTRQIGSSD (SEQ ID NO: 4754) | 6 |
| 5 | QIGSSDTDP (SEQ ID NO: 4755) | 4 |
| 8 | SSDTDPPAD (SEQ ID NO: 4756) | 3 |

TABLE XXVIII

V27-HLA-B08-9mers-PSCA

Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | SRGQALRRA (SEQ ID NO: 4757) | 2 |
| 2 | RGQALRRAQ (SEQ ID NO: 4758) | 1 |

TABLE XXIX

V1-HLA-B1510-9mers-PSCA

Each peptide is a portion of SEQ ID NO: 2; each start position is specified, the length of peptide is 9 amino acids, and the end position for each peptide is the start position plus eight.

| Pos | 123456789 | score |
|---|---|---|
| 13 | LALQPGTAL (SEQ ID NO: 4759) | 13 |

TABLE XXIX-continued

V1-HLA-B1510-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 14 | ALQPGTALL (SEQ ID NO: 4760) | 13 |
| 50 | TARIRAVGL (SEQ ID NO: 4761) | 13 |
| 92 | CNASGAHAL (SEQ ID NO: 4762) | 13 |
| 97 | AHALQPAAA (SEQ ID NO: 4763) | 13 |
| 101 | QPAAAILAL (SEQ ID NO: 4764) | 13 |
| 1 | MKAVLLALL (SEQ ID NO: 4765) | 12 |
| 5 | LLALLMAGL (SEQ ID NO: 4766) | 12 |
| 36 | LQVENCTQL (SEQ ID NO: 4767) | 12 |
| 99 | ALQPAAAIL (SEQ ID NO: 4768) | 12 |
| 105 | AILALLPAL (SEQ ID NO: 4769) | 12 |
| 108 | ALLPALGLL (SEQ ID NO: 4770) | 12 |
| 115 | LLLWGPGQL (SEQ ID NO: 4771) | 12 |
| 7 | ALLMAGLAL (SEQ ID NO: 4772) | 11 |
| 28 | AQVSNEDCL (SEQ ID NO: 4773) | 11 |
| 51 | ARIRAVGLL (SEQ ID NO: 4774) | 11 |
| 60 | TVISKGCSL (SEQ ID NO: 4775) | 11 |
| 102 | PAAAILALL (SEQ ID NO: 4776) | 11 |

TABLE XXIX-continued

V1-HLA-B1510-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 107 | LALLPALGL (SEQ ID NO: 4777) | 11 |
| 83 | NITCCDTDL (SEQ ID NO: 4778) | 10 |
| 109 | LLPALGLLL (SEQ ID NO: 4779) | 10 |
| 2 | KAVLLALLM (SEQ ID NO: 4780) | 6 |
| 53 | IRAVGLLTV (SEQ ID NO: 4781) | 6 |

TABLE XXIX

V4-HLA-B1510-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 103 | PHPDPPMAL (SEQ ID NO: 4782) | 24 |
| 139 | FHGPAFSTL (SEQ ID NO: 4783) | 23 |
| 152 | RHLFPQEAF (SEQ ID NO: 4784) | 18 |
| 88 | AHPNASLTM (SEQ ID NO: 4785) | 17 |
| 55 | WGAPLQPTL (SEQ ID NO: 4786) | 15 |
| 76 | HPAQWEPVL (SEQ ID NO: 4787) | 15 |
| 146 | TLNPVLRHL (SEQ ID NO: 4788) | 15 |
| 46 | SGDPASYRL (SEQ ID NO: 4789) | 14 |
| 143 | AFSTLNPVL (SEQ ID NO: 4790) | 14 |

TABLE XXIX-continued

V4-HLA-B1510-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 24 | AGPMPCSRL (SEQ ID NO: 4791) | 13 |
| 28 | PCSRLPPSL (SEQ ID NO: 4792) | 13 |
| 65 | VVPQASVPL (SEQ ID NO: 4793) | 13 |
| 160 | FPAHPIYDL (SEQ ID NO: 4794) | 13 |
| 2 | THRTTTWAR (SEQ ID NO: 4795) | 12 |
| 66 | VPQASVPLL (SEQ ID NO: 4796) | 12 |
| 86 | PEAHPNASL (SEQ ID NO: 4797) | 12 |
| 127 | PADGPSNPL (SEQ ID NO: 4798) | 12 |
| 32 | LPPSLRCSL (SEQ ID NO: 4799) | 11 |
| 40 | LHSACCSGD (SEQ ID NO: 4800) | 11 |
| 75 | THPAQWEPV (SEQ ID NO: 4801) | 11 |
| 177 | PAPSRGQAL (SEQ ID NO: 4802) | 11 |

TABLE XXIX

V19-HLA-B1510-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 1 | GPMPCSRLL (SEQ ID NO: 4803) | 15 |
| 4 | PCSRLLPSL (SEQ ID NO: 4804) | 12 |

TABLE XXIX-continued

V19-HLA-B1510-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 8 | LLPSLRCSL (SEQ ID NO: 4805) | 11 |

TABLE XXIX

V20-HLA-B1510-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 3 | SGDPASSRL (SEQ ID NO: 4806) | 14 |
| 8 | SSRLWGAPL (SEQ ID NO: 4807) | 10 |

TABLE XXIX

V21-HLA-B1510-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 9 | DPAQWEPVL (SEQ ID NO: 4808) | 15 |

TABLE XXIX

V21&22-HLA-B1510-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 8 | DLAQWEPVL (SEQ ID NO: 4809) | 15 |
| 1 | ASVPLLTDL (SEQ ID NO: 4810) | 12 |

TABLE XXIX

V22-HLA-B1510-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 8 | HLAQWEPVL (SEQ ID NO: 4811) | 15 |
| 1 | ASVPLLTHL (SEQ ID NO: 4812) | 12 |
| 7 | THLAQWEPV (SEQ ID NO: 4813) | 11 |

TABLE XXIX

V24-HLA-B1510-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 4 | TMYVCTPVP (SEQ ID NO: 4814) | 5 |
| 6 | YVCTPVPHP (SEQ ID NO: 4815) | 4 |
| 5 | MYVCTPVPH (SEQ ID NO: 4816) | 3 |
| 7 | VCTPVPHPD (SEQ ID NO: 4817) | 3 |
| 8 | CTPVPHPDP (SEQ ID NO: 4818) | 3 |
| 1 | ASLTMYVCT (SEQ ID NO: 4819) | 2 |
| 2 | SLTMYVCTP (SEQ ID NO: 4820) | 2 |

TABLE XXIX

V25-HLA-B1510-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | SRTPTRQIS (SEQ ID NO: 4821) | 3 |
| 8 | ISSIDTDPP (SEQ ID NO: 4822) | 3 |
| 3 | TPTRQISSI (SEQ ID NO: 4823) | 2 |
| 6 | RQISSIDTD (SEQ ID NO: 4824) | 2 |
| 9 | SSIDTDPPA (SEQ ID NO: 4825) | 2 |
| 4 | PTRQISSID (SEQ ID NO: 4826) | 1 |
| 5 | TRQISSIDT (SEQ ID NO: 4827) | 1 |
| 7 | QISSIDTDP (SEQ ID NO: 4828) | 1 |

TABLE XXIX

V25&26-HLA-B1510-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 6 | ISSSDTDPP (SEQ ID NO: 4829) | 3 |
| 7 | SSSDTDPPA (SEQ ID NO: 4830) | 3 |
| 1 | TPTRQISSS (SEQ ID NO: 4831) | 2 |
| 2 | PTRQISSSD (SEQ ID NO: 4832) | 1 |

TABLE XXIX-continued

V25&26-HLA-B1510-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | TRQISSSDT (SEQ ID NO: 4833) | 1 |
| 4 | RQISSSDTD (SEQ ID NO: 4834) | 1 |
| 5 | QISSSDTDP (SEQ ID NO: 4835) | 1 |

TABLE XXIX

V26-HLA-B1510-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 7 | GSSDTDPPA (SEQ ID NO: 4836) | 4 |
| 6 | IGSSDTDPP (SEQ ID NO: 4837) | 3 |
| 8 | SSDTDPPAD (SEQ ID NO: 4838) | 3 |
| 9 | SDTDPPADG (SEQ ID NO: 4839) | 3 |
| 1 | TPTRQIGSS (SEQ ID NO: 4840) | 2 |
| 3 | TRQIGSSDT (SEQ ID NO: 4841) | 2 |
| 4 | RQIGSSDTD (SEQ ID NO: 4842) | 2 |
| 2 | PTRQIGSSD (SEQ ID NO: 4843) | 1 |

TABLE XXX

V1-HLA-B2705-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 51 | ARIRAVGLL (SEQ ID NO: 4846) | 24 |
| 54 | RAVGLLTVI (SEQ ID NO: 4847) | 18 |
| 13 | LALQPGTAL (SEQ ID NO: 4848) | 17 |
| 53 | IRAVGLLTV (SEQ ID NO: 4849) | 16 |
| 56 | VGLLTVISK (SEQ ID NO: 4850) | 16 |
| 105 | AILALLPAL (SEQ ID NO: 4851) | 16 |
| 107 | LALLPALGL (SEQ ID NO: 4852) | 16 |
| 2 | KAVLLALLM (SEQ ID NO: 4853) | 15 |
| 14 | ALQPGTALL (SEQ ID NO: 4854) | 15 |
| 36 | LQVENCTQL (SEQ ID NO: 4855) | 15 |
| 108 | ALLPALGLL (SEQ ID NO: 4856) | 15 |
| 115 | LLLWGPGQL (SEQ ID NO: 4857) | 15 |
| 7 | ALLMAGLAL (SEQ ID NO: 4858) | 14 |
| 19 | TALLCYSCK (SEQ ID NO: 4859) | 14 |
| 44 | LGEQCWTAR (SEQ ID NO: 4860) | 14 |
| 60 | TVISKGCSL (SEQ ID NO: 4861) | 14 |
| 99 | ALQPAAAIL (SEQ ID NO: 4862) | 14 |
| 101 | QPAAAILAL (SEQ ID NO: 4863) | 14 |

TABLE XXX-continued

V1-HLA-B2705-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 1 | MKAVLLALL (SEQ ID NO: 4864) | 13 |
| 5 | LLALLMAGL (SEQ ID NO: 4865) | 13 |
| 74 | SQDYYVGKK (SEQ ID NO: 4866) | 13 |
| 76 | DYYVGKKNI (SEQ ID NO: 4867) | 13 |
| 83 | NITCCDTDL (SEQ ID NO: 4868) | 13 |
| 92 | CNASGAHAL (SEQ ID NO: 4869) | 13 |
| 98 | HALQPAAAI (SEQ ID NO: 4870) | 13 |
| 102 | PAAAILALL (SEQ ID NO: 4871) | 13 |
| 28 | AQVSNEDCL (SEQ ID NO: 4872) | 12 |
| 45 | GEQCWTARI (SEQ ID NO: 4873) | 12 |
| 50 | TARIRAVGL (SEQ ID NO: 4874) | 12 |
| 57 | GLLTVISKG (SEQ ID NO: 4875) | 12 |
| 109 | LLPALGLLL (SEQ ID NO: 4876) | 12 |
| 46 | EQCWTARIR (SEQ ID NO: 4877) | 11 |
| 70 | CVDDSQDYY (SEQ ID NO: 4878) | 11 |
| 73 | DSQDYYVGK (SEQ ID NO: 4879) | 11 |

TABLE XXX

V4-HLA-B2705-9mers-PSCA
Each peptide is a portion of SEQ ID NO:8; each start position is specified, the length of peptide is 9 amino acids, and the end position for each peptide is the start position plus eight.

| Pos | 123456789 | score |
|---|---|---|
| 3 | HRTTTWARR (SEQ ID NO: 4880) | 23 |
| 152 | RHLFPQEAF (SEQ ID NO: 4881) | 19 |
| 30 | SRLPPSLRC (SEQ ID NO: 4882) | 18 |
| 10 | RRTSRAVTP (SEQ ID NO: 4883) | 17 |
| 52 | YRLWGAPLQ (SEQ ID NO: 4884) | 16 |
| 55 | WGAPLQPTL (SEQ ID NO: 4885) | 16 |
| 178 | APSRGQALR (SEQ ID NO: 4886) | 16 |
| 179 | PSRGQALRR (SEQ ID NO: 4887) | 16 |
| 24 | AGPMPCSRL (SEQ ID NO: 4888) | 15 |
| 46 | SGDPASYRL (SEQ ID NO: 4889) | 15 |
| 127 | PADGPSNPL (SEQ ID NO: 4890) | 15 |
| 143 | AFSTLNPVL (SEQ ID NO: 4891) | 15 |
| 145 | STLNPVLRH (SEQ ID NO: 4892) | 15 |
| 160 | FPAHPIYDL (SEQ ID NO: 4893) | 15 |
| 173 | SVVSPAPSR (SEQ ID NO: 4894) | 15 |
| 180 | SRGQALRRA (SEQ ID NO: 4895) | 15 |
| 181 | RGQALRRAR (SEQ ID NO: 4896) | 15 |

TABLE XXX-continued

V4-HLA-B2705-9mers-PSCA
Each peptide is a portion of SEQ ID NO:8; each start position is specified, the length of peptide is 9 amino acids, and the end position for each peptide is the start position plus eight.

| Pos | 123456789 | score |
|---|---|---|
| 9 | ARRTSRAVT (SEQ ID NO: 4897) | 14 |
| 65 | VVPQASVPL (SEQ ID NO: 4898) | 14 |
| 76 | HPAQWEPVL (SEQ ID NO: 4899) | 14 |
| 86 | PEAHPNASL (SEQ ID NO: 4900) | 14 |
| 105 | PDPPMALSR (SEQ ID NO: 4901) | 14 |
| 109 | MALSRTPTR (SEQ ID NO: 4902) | 14 |
| 116 | TRQIGSIDT (SEQ ID NO: 4903) | 14 |
| 6 | TTWARRTSR (SEQ ID NO: 4904) | 13 |
| 28 | PCSRLPPSL (SEQ ID NO: 4905) | 13 |
| 29 | CSRLPPSLR (SEQ ID NO: 4906) | 13 |
| 45 | CSGDPASYR (SEQ ID NO: 4907) | 13 |
| 66 | VPQASVPLL (SEQ ID NO: 4908) | 13 |
| 117 | RQIGSIDTD (SEQ ID NO: 4909) | 13 |
| 139 | FHGPAFSTL (SEQ ID NO: 4910) | 13 |
| 146 | TLNPVLRHL (SEQ ID NO: 4911) | 13 |
| 158 | EAFPAHPIY (SEQ ID NO: 4912) | 13 |

TABLE XXX-continued

V4-HLA-B2705-9mers-PSCA
Each peptide is a portion of SEQ ID NO:8; each start position is specified, the length of peptide is 9 amino acids, and the end position for each peptide is the start position plus eight.

| Pos | 123456789 | score |
|---|---|---|
| 13 | SRAVTPTCA (SEQ ID NO: 4913) | 12 |
| 23 | PAGPMPCSR (SEQ ID NO: 4914) | 12 |
| 32 | LPPSLRCSL (SEQ ID NO: 4915) | 12 |
| 36 | LRCSLHSAC (SEQ ID NO: 4916) | 12 |
| 44 | CCSGDPASY (SEQ ID NO: 4917) | 12 |
| 51 | SYRLWGAPL (SEQ ID NO: 4918) | 12 |
| 68 | QASVPLLTH (SEQ ID NO: 4919) | 12 |
| 88 | AHPNASLTM (SEQ ID NO: 4920) | 12 |
| 89 | HPNASLTMY (SEQ ID NO: 4921) | 12 |
| 103 | PHPDPPMAL (SEQ ID NO: 4922) | 12 |
| 131 | PSNPLCCCF (SEQ ID NO: 4923) | 12 |
| 144 | FSTLNPVLR (SEQ ID NO: 4924) | 12 |
| 151 | LRHLFPQEA (SEQ ID NO: 4925) | 12 |
| 2 | THRTTTWAR (SEQ ID NO: 4926) | 11 |
| 81 | EPVLVPEAH (SEQ ID NO: 4927) | 11 |
| 101 | PVPHPDPPM (SEQ ID NO: 4928) | 11 |

TABLE XXX-continued

V4-HLA-B2705-9mers-PSCA
Each peptide is a portion of SEQ ID NO:8; each start position is specified, the length of peptide is 9 amino acids, and the end position for each peptide is the start position plus eight.

| Pos | 123456789 | score |
|---|---|---|
| 112 | SRTPTRQIG (SEQ ID NO: 4929) | 11 |
| 136 | CCCFHGPAF (SEQ ID NO: 4930) | 11 |
| 147 | LNPVLRHLF (SEQ ID NO: 4931) | 11 |

TABLE XXX

V19-HLA-B2705-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 6 | SRLLPSLRC (SEQ ID NO: 4932) | 18 |
| 1 | GPMPCSRLL (SEQ ID NO: 4933) | 15 |
| 4 | PCSRLLPSL (SEQ ID NO: 4934) | 14 |
| 5 | CSRLLPSLR (SEQ ID NO: 4935) | 13 |
| 8 | LLPSLRCSL (SEQ ID NO: 4936) | 12 |
| 9 | LPSLRCSLH (SEQ ID NO: 4937) | 10 |
| 7 | RLLPSLRCS (SEQ ID NO: 4938) | 9 |

TABLE XXX

V20-HLA-B2705-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 9 | SRLWGAPLQ (SEQ ID NO: 4939) | 16 |

TABLE XXX-continued

V20-HLA-B2705-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | SGDPASSRL (SEQ ID NO: 4940) | 15 |
| 2 | CSGDPASSR (SEQ ID NO: 4941) | 14 |
| 8 | SSRLWGAPL (SEQ ID NO: 4942) | 12 |

TABLE XXX

V21-HLA-B2705-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 9 | DPAQWEPVL (SEQ ID NO: 4943) | 14 |
| 2 | ASVPLLTDP (SEQ ID NO: 4944) | 7 |

TABLE XXX

V21&22-HLA-B2705-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | ASVPLLTDL (SEQ ID NO: 4945) | 17 |
| 8 | DLAQWEPVL (SEQ ID NO: 4946) | 14 |

TABLE XXX

V22-HLA-B2705-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | ASVPLLTHL (SEQ ID NO: 4947) | 17 |

TABLE XXX-continued

V22-HLA-B2705-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 8 | HLAQWEPVL (SEQ ID NO: 4948) | 14 |

TABLE XXX

V24-HLA-B2705-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 5 | MYVCTPVPH (SEQ ID NO: 4949) | 10 |
| 1 | ASLTMYVCT (SEQ ID NO: 4950) | 4 |
| 4 | TMYVCTPVP (SEQ ID NO: 4951) | 4 |
| 5 | TRQISSIDT (SEQ ID NO: 4952) | 13 |
| 1 | SRTPTRQIS (SEQ ID NO: 4953) | 11 |
| 3 | TPTRQISSI (SEQ ID NO: 4954) | 11 |
| 6 | RQISSIDTD (SEQ ID NO: 4955) | 11 |
| 2 | RTPTRQISS (SEQ ID NO: 4956) | 8 |

TABLE XXX

V25&26-HLA-B2705-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | TRQISSSDT (SEQ ID NO: 4957) | 13 |
| 4 | RQISSSDTD (SEQ ID NO: 4958) | 9 |
| 2 | PTRQISSSD (SEQ ID NO: 4959) | 6 |

TABLE XXX

V26-HLA-B2705-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | TRQIGSSDT (SEQ ID NO: 4960) | 14 |
| 4 | RQIGSSDTD (SEQ ID NO: 4961) | 11 |

TABLE XXX

V27-HLA-B2705-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | SRGQALRRA (SEQ ID NO: 4962) | 15 |

TABLE XXXI

V1-HLA-B2709-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 51 | ARIRAVGLL (SEQ ID NO: 4963) | 23 |
| 53 | IRAVGLLTV (SEQ ID NO: 4964) | 20 |

TABLE XXXI-continued

V1-HLA-B2709-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 7 | ALLMAGLAL (SEQ ID NO: 4965) | 14 |
| 105 | AILALLPAL (SEQ ID NO: 4966) | 14 |
| 107 | LALLPALGL (SEQ ID NO: 4967) | 14 |
| 108 | ALLPALGLL (SEQ ID NO: 4968) | 14 |
| 2 | KAVLLALLM (SEQ ID NO: 4969) | 13 |
| 28 | AQVSNEDCL (SEQ ID NO: 4970) | 13 |
| 54 | RAVGLLTVI (SEQ ID NO: 4971) | 13 |
| 99 | ALQPAAAIL (SEQ ID NO: 4972) | 13 |
| 115 | LLLWGPGQL (SEQ ID NO: 4973) | 13 |
| 13 | LALQPGTAL (SEQ ID NO: 4974) | 12 |
| 14 | ALQPGTALL (SEQ ID NO: 4975) | 12 |
| 22 | LCYSCKAQV (SEQ ID NO: 4976) | 12 |
| 36 | LQVENCTQL (SEQ ID NO: 4977) | 12 |
| 45 | GEQCWTARI (SEQ ID NO: 4978) | 12 |
| 50 | TARIRAVGL (SEQ ID NO: 4979) | 12 |
| 60 | TVISKGCSL (SEQ ID NO: 4980) | 12 |
| 92 | CNASGAHAL (SEQ ID NO: 4981) | 12 |

TABLE XXXI-continued

V1-HLA-B2709-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 30 | VSNEDCLQV (SEQ ID NO: 4982) | 11 |
| 76 | DYYVGKKNI (SEQ ID NO: 4983) | 11 |
| 83 | NITCCDTDL (SEQ ID NO: 4984) | 11 |
| 98 | HALQPAAAI (SEQ ID NO: 4985) | 11 |
| 101 | QPAAAILAL (SEQ ID NO: 4986) | 11 |
| 102 | PAAAILALL (SEQ ID NO: 4987) | 11 |
| 109 | LLPALGLLL (SEQ ID NO: 4988) | 11 |

TABLE XXXI

V4-HLA-B2709-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 10 | RRTSRAVTP (SEQ ID NO: 4989) | 18 |
| 30 | SRLPPSLRC (SEQ ID NO: 4990) | 15 |
| 52 | YRLWGAPLQ (SEQ ID NO: 4991) | 14 |
| 152 | RHLFPQEAF (SEQ ID NO: 4992) | 14 |
| 46 | SGDPASYRL (SEQ ID NO: 4993) | 13 |

TABLE XXXI-continued

V4-HLA-B2709-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | HRTTTWARR (SEQ ID NO: 4994) | 12 |
| 24 | AGPMPCSRL (SEQ ID NO: 4995) | 12 |
| 55 | WGAPLQPTL (SEQ ID NO: 4996) | 12 |
| 57 | APLQPTLGV (SEQ ID NO: 4997) | 12 |
| 66 | VPQASVPLL (SEQ ID NO: 4998) | 12 |
| 112 | SRTPTRQIG (SEQ ID NO: 4999) | 12 |
| 143 | AFSTLNPVL (SEQ ID NO: 5000) | 12 |
| 166 | YDLSQVWSV (SEQ ID NO: 5001) | 12 |
| 9 | ARRTSRAVT (SEQ ID NO: 5002) | 11 |
| 28 | PCSRLPPSL (SEQ ID NO: 5003) | 11 |
| 32 | LPPSLRCSL (SEQ ID NO: 5004) | 11 |
| 36 | LRCSLHSAC (SEQ ID NO: 5005) | 11 |
| 65 | VVPQASVPL (SEQ ID NO: 5006) | 11 |
| 76 | HPAQWEPVL (SEQ ID NO: 5007) | 11 |
| 139 | FHGPAFSTL (SEQ ID NO: 5008) | 11 |
| 142 | PAFSTLNPV (SEQ ID NO: 5009) | 11 |
| 146 | TLNPVLRHL (SEQ ID NO: 5010) | 11 |
| 160 | FPAHPIYDL (SEQ ID NO: 5011) | 11 |
| 163 | HPIYDLSQV (SEQ ID NO: 5012) | 11 |
| 177 | PAPSRGQAL (SEQ ID NO: 5013) | 11 |
| 180 | SRGQALRRA (SEQ ID NO: 5014) | 11 |
| 13 | SRAVTPTCA (SEQ ID NO: 5015) | 10 |
| 51 | SYRLWGAPL (SEQ ID NO: 5016) | 10 |
| 86 | PEAHPNASL (SEQ ID NO: 5017) | 10 |
| 88 | AHPNASLTM (SEQ ID NO: 5018) | 10 |
| 103 | PHPDPPMAL (SEQ ID NO: 5019) | 10 |
| 116 | TRQIGSIDT (SEQ ID NO: 5020) | 10 |
| 127 | PADGPSNPL (SEQ ID NO: 5021) | 10 |
| 151 | LRHLFPQEA (SEQ ID NO: 5022) | 10 |
| 19 | TCATPAGPM (SEQ ID NO: 5023) | 9 |
| 58 | PLQPTLGVV (SEQ ID NO: 5024) | 9 |
| 63 | LGVVPQASV (SEQ ID NO: 5025) | 9 |

TABLE XXXI-continued

V4-HLA-B2709-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 77 | PAQWEPVLV (SEQ ID NO: 5026) | 9 |
| 90 | PNASLTMYV (SEQ ID NO: 5027) | 9 |
| 101 | PVPHPDPPM (SEQ ID NO: 5028) | 9 |
| 111 | LSRTPTRQI (SEQ ID NO: 5029) | 9 |
| 114 | TPTRQIGSI (SEQ ID NO: 5030) | 9 |
| 131 | PSNPLCCCF (SEQ ID NO: 5031) | 9 |
| 136 | CCCFHGPAF (SEQ ID NO: 5032) | 9 |
| 157 | QEAFPAHPI (SEQ ID NO: 5033) | 9 |
| 8 | WARRTSRAV (SEQ ID NO: 5034) | 8 |
| 75 | THPAQWEPV (SEQ ID NO: 5035) | 8 |
| 94 | LTMYVCAPV (SEQ ID NO: 5036) | 8 |
| 147 | LNPVLRHLF (SEQ ID NO: 5037) | 8 |
| 167 | DLSQVWSVV (SEQ ID NO: 5038) | 8 |

TABLE XXXI

V19-HLA-B2709-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | GPMPCSRLL (SEQ ID NO: 5039) | 14 |
| 6 | SRLLPSLRC (SEQ ID NO: 5040) | 14 |
| 4 | PCSRLLPSL (SEQ ID NO: 5041) | 11 |
| 8 | LLPSLRCSL (SEQ ID NO: 5042) | 11 |
| 7 | RLLPSLRCS (SEQ ID NO: 5043) | 7 |

TABLE XXXI

V20-HLA-B2709-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 9 | SRLWGAPLQ (SEQ ID NO: 5044) | 14 |
| 3 | SGDPASSRL (SEQ ID NO: 5045) | 12 |
| 8 | SSRLWGAPL (SEQ ID NO: 5046) | 10 |

TABLE XXXI

V21-HLA-B2709-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 9 | DPAQWEPVL (SEQ ID NO: 5047) | 11 |
| 8 | TDPAQWEPV (SEQ ID NO: 5048) | 8 |

TABLE XXXI

V21&22-HLA-B2709-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | ASVPLLTDL (SEQ ID NO: 5049) | 13 |
| 8 | DLAQWEPVL (SEQ ID NO: 5050) | 11 |
| 7 | TDLAQWEPV (SEQ ID NO: 5051) | 10 |

TABLE XXXI

V22-HLA-B2709-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | ASVPLLTHL (SEQ ID NO: 5052) | 13 |
| 8 | HLAQWEPVL (SEQ ID NO: 5053) | 11 |
| 7 | THLAQWEPV (SEQ ID NO: 5054) | 10 |
| 9 | LAQWEPVLV (SEQ ID NO: 5055) | 9 |

TABLE XXXI

V24-HLA-B2709-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | LTMYVCTPV (SEQ ID NO: 5056) | 8 |
| 1 | ASLTMYVCT (SEQ ID NO: 5057) | 4 |
| 4 | TMYVCTPVP (SEQ ID NO: 5058) | 3 |

TABLE XXXI

V25-HLA-B2709-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | SRTPTRQIS (SEQ ID NO: 5059) | 12 |
| 5 | TRQISSIDT (SEQ ID NO: 5060) | 10 |
| 3 | TPTRQISSI (SEQ ID NO: 5061) | 9 |
| 6 | RQISSIDTD (SEQ ID NO: 5062) | 6 |

TABLE XXXI

V25&26-HLA-B2709-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | TRQISSSDT (SEQ ID NO: 5063) | 10 |
| 4 | RQISSSDTD (SEQ ID NO: 5064) | 6 |

TABLE XXXI

V26-HLA-B2709-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | TRQIGSSDT (SEQ ID NO: 5065) | 10 |
| 4 | RQIGSSDTD (SEQ ID NO: 5066) | 5 |
| 7 | GSSDTDPPA (SEQ ID NO: 5067) | 4 |

TABLE XXXI

V27-HLA-B2709-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | SRGQALRRA (SEQ ID NO: 5068) | 11 |

TABLE XXXII

V1-HLA-B4402-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 45 | GEQCWTARI (SEQ ID NO: 5069) | 19 |
| 51 | ARIRAVGLL (SEQ ID NO: 5070) | 19 |
| 108 | ALLPALGLL (SEQ ID NO: 5071) | 19 |
| 14 | ALQPGTALL (SEQ ID NO: 5072) | 18 |
| 7 | ALLMAGLAL (SEQ ID NO: 5073) | 17 |
| 99 | ALQPAAAIL (SEQ ID NO: 5074) | 17 |
| 105 | AILALLPAL (SEQ ID NO: 5075) | 17 |
| 101 | QPAAAILAL (SEQ ID NO: 5076) | 16 |
| 28 | AQVSNEDCL (SEQ ID NO: 5077) | 14 |
| 92 | CNASGAHAL (SEQ ID NO: 5078) | 14 |
| 107 | LALLPALGL (SEQ ID NO: 5079) | 14 |
| 110 | LPALGLLLW (SEQ ID NO: 5080) | 14 |
| 13 | LALQPGTAL (SEQ ID NO: 5081) | 13 |
| 16 | QPGTALLCY (SEQ ID NO: 5082) | 13 |
| 32 | NEDCLQVEN (SEQ ID NO: 5083) | 13 |
| 50 | TARIRAVGL (SEQ ID NO: 5084) | 13 |
| 60 | TVISKGCSL (SEQ ID NO: 5085) | 13 |
| 102 | PAAAILALL (SEQ ID NO: 5086) | 13 |
| 109 | LLPALGLLL (SEQ ID NO: 5087) | 13 |
| 115 | LLLWGPGQL (SEQ ID NO: 5088) | 13 |
| 1 | MKAVLLALL (SEQ ID NO: 5089) | 12 |
| 36 | LQVENCTQL (SEQ ID NO: 5090) | 12 |
| 69 | NCVDDSQDY (SEQ ID NO: 5091) | 12 |
| 70 | CVDDSQDYY (SEQ ID NO: 5092) | 12 |
| 98 | HALQPAAAI (SEQ ID NO: 5093) | 12 |
| 5 | LLALLMAGL (SEQ ID NO: 5094) | 11 |
| 38 | VENCTQLGE (SEQ ID NO: 5095) | 11 |
| 41 | CTQLGEQCW (SEQ ID NO: 5096) | 11 |
| 54 | RAVGLLTVI (SEQ ID NO: 5097) | 11 |
| 83 | NITCCDTDL (SEQ ID NO: 5098) | 11 |

TABLE XXXII-continued

V1-HLA-B4402-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 76 | DYYVGKKNI (SEQ ID NO: 5099) | 10 |
| 104 | AAILALLPA (SEQ ID NO: 5100) | 9 |

TABLE XXXII

V4-HLA-B4402-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 86 | PEAHPNASL (SEQ ID NO: 5101) | 20 |
| 157 | QEAFPAHPI (SEQ ID NO: 5102) | 20 |
| 158 | EAFPAHPIY (SEQ ID NO: 5103) | 17 |
| 143 | AFSTLNPVL (SEQ ID NO: 5104) | 16 |
| 46 | SGDPASYRL (SEQ ID NO: 5105) | 15 |
| 103 | PHPDPPMAL (SEQ ID NO: 5106) | 15 |
| 139 | FHGPAFSTL (SEQ ID NO: 5107) | 15 |
| 146 | TLNPVLRHL (SEQ ID NO: 5108) | 15 |
| 24 | AGPMPCSRL (SEQ ID NO: 5109) | 14 |
| 55 | WGAPLQPTL (SEQ ID NO: 5110) | 14 |
| 72 | PLLTHPAQW (SEQ ID NO: 5111) | 14 |
| 147 | LNPVLRHLF (SEQ ID NO: 5112) | 14 |

TABLE XXXII-continued

V4-HLA-B4402-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 177 | PAPSRGQAL (SEQ ID NO: 5113) | 14 |
| 28 | PCSRLPPSL (SEQ ID NO: 5114) | 13 |
| 44 | CCSGDPASY (SEQ ID NO: 5115) | 13 |
| 47 | GDPASYRLW (SEQ ID NO: 5116) | 13 |
| 127 | PADGPSNPL (SEQ ID NO: 5117) | 13 |
| 131 | PSNPLCCCF (SEQ ID NO: 5118) | 13 |
| 152 | RHLFPQEAF (SEQ ID NO: 5119) | 13 |
| 160 | FPAHPIYDL (SEQ ID NO: 5120) | 13 |
| 32 | LPPSLRCSL (SEQ ID NO: 5121) | 12 |
| 51 | SYRLWGAPL (SEQ ID NO: 5122) | 12 |
| 65 | VVPQASVPL (SEQ ID NO: 5123) | 12 |
| 66 | VPQASVPLL (SEQ ID NO: 5124) | 12 |
| 80 | WEPVLVPEA (SEQ ID NO: 5125) | 12 |
| 111 | LSRTPTRQI (SEQ ID NO: 5126) | 12 |
| 114 | TPTRQIGSI (SEQ ID NO: 5127) | 12 |
| 136 | CCCFHGPAF (SEQ ID NO: 5128) | 12 |
| 164 | PIYDLSQVW (SEQ ID NO: 5129) | 12 |
| 76 | HPAQWEPVL (SEQ ID NO: 5130) | 11 |

TABLE XXXII-continued

V4-HLA-B4402-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 89 | HPNASLTMY (SEQ ID NO: 5131) | 11 |

TABLE XXXII

V19-HLA-B4402-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | GPMPCSRLL (SEQ ID NO: 5132) | 16 |
| 4 | PCSRLLPSL (SEQ ID NO: 5133) | 13 |
| 8 | LLPSLRCSL (SEQ ID NO: 5134) | 12 |
| 7 | RLLPSLRCS (SEQ ID NO: 5135) | 6 |

TABLE XXXII

V20-HLA-B4402-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | SGDPASSRL (SEQ ID NO: 5136) | 15 |
| 4 | GDPASSRLW (SEQ ID NO: 5137) | 13 |
| 8 | SSRLWGAPL (SEQ ID NO: 5138) | 12 |
| 7 | ASSRLWGAP (SEQ ID NO: 5139) | 7 |

TABLE XXXII

V21-HLA-B4402-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 5 | PLLTDPAQW (SEQ ID NO: 5140) | 14 |
| 9 | DPAQWEPVL (SEQ ID NO: 5141) | 11 |
| 2 | ASVPLLTDP (SEQ ID NO: 5142) | 7 |

TABLE XXXII

V21&22-HLA-B4402-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | ASVPLLTDL (SEQ ID NO: 5143) | 17 |
| 4 | PLLTDLAQW (SEQ ID NO: 5144) | 14 |
| 8 | DLAQWEPVL (SEQ ID NO: 5145) | 11 |

TABLE XXXII

V22-HLA-B4402-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | ASVPLLTHL (SEQ ID NO: 5146) | 17 |
| 4 | PLLTHLAQW (SEQ ID NO: 5147) | 14 |
| 8 | HLAQWEPVL (SEQ ID NO: 5148) | 11 |

TABLE XXXII

V24-HLA-B4402-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | ASLTMYVCT (SEQ ID NO: 5149) | 6 |
| 7 | VCTPVPHPD (SEQ ID NO: 5150) | 5 |
| 2 | SLTMYVCTP (SEQ ID NO: 5151) | 3 |
| 4 | TMYVCTPVP (SEQ ID NO: 5152) | 2 |
| 5 | MYVCTPVPH (SEQ ID NO: 5153) | 2 |
| 6 | YVCTPVPHP (SEQ ID NO: 5154) | 2 |

TABLE XXXII

V25-HLA-B4402-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | TPTRQISSI (SEQ ID NO: 5155) | 12 |
| 6 | RQISSIDTD (SEQ ID NO: 5156) | 7 |
| 1 | SRTPTRQIS (SEQ ID NO: 5157) | 5 |
| 9 | SSIDTDPPA (SEQ ID NO: 5158) | 5 |

TABLE XXXII

V25&26-HLA-B4402-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | TPTRQISSS (SEQ ID NO: 5159) | 4 |
| 4 | RQISSSDTD (SEQ ID NO: 5160) | 4 |
| 7 | SSSDTDPPA (SEQ ID NO: 5161) | 3 |
| 6 | ISSSDTDPP (SEQ ID NO: 5162) | 2 |
| 2 | PTRQISSSD (SEQ ID NO: 5163) | 1 |
| 5 | QISSSDTDP (SEQ ID NO: 5164) | 1 |

TABLE XXXII

V26-HLA-B4402-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 8 | SSDTDPPAD (SEQ ID NO: 5165) | 6 |
| 4 | RQIGSSDTD (SEQ ID NO: 5166) | 5 |
| 1 | TPTRQIGSS (SEQ ID NO: 5167) | 4 |
| 9 | SDTDPPADG (SEQ ID NO: 5168) | 3 |
| 6 | IGSSDTDPP (SEQ ID NO: 5169) | 2 |

TABLE XXXII

V27-HLA-B4402-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 2 | RGQALRRAQ (SEQ ID NO: 5170) | 4 |
| 1 | SRGQALRRA (SEQ ID NO: 5171) | 3 |

TABLE XXXIIII

V1-HLA-B5101-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 54 | RAVGLLTVI (SEQ ID NO: 5172) | 26 |
| 98 | HALQPAAAI (SEQ ID NO: 5173) | 23 |
| 107 | LALLPALGL (SEQ ID NO: 5174) | 22 |
| 13 | LALQPGTAL (SEQ ID NO: 5175) | 21 |
| 50 | TARIRAVGL (SEQ ID NO: 5176) | 19 |
| 76 | DYYVGKKNI (SEQ ID NO: 5177) | 19 |
| 101 | QPAAAILAL (SEQ ID NO: 5178) | 19 |
| 102 | PAAAILALL (SEQ ID NO: 5179) | 18 |
| 6 | LALLMAGLA (SEQ ID NO: 5180) | 16 |
| 111 | PALGLLLWG (SEQ ID NO: 5181) | 15 |
| 22 | LCYSCKAQV (SEQ ID NO: 5182) | 14 |
| 53 | IRAVGLLTV (SEQ ID NO: 5183) | 14 |

TABLE XXXIIII-continued

V1-HLA-B5101-9mers-PSCA
Each peptide is a portion of SEQ ID NO: 2; each start position is specified, the length of peptide is 9 amino acids, and the end position for each peptide is the start position plus eight.

| Pos | 123456789 | score |
|---|---|---|
| 110 | LPALGLLLW (SEQ ID NO: 5184) | 14 |
| 16 | QPGTALLCY (SEQ ID NO: 5185) | 13 |
| 19 | TALLCYSCK (SEQ ID NO: 5186) | 13 |
| 56 | VGLLTVISK (SEQ ID NO: 5187) | 13 |
| 2 | KAVLLALLM (SEQ ID NO: 5188) | 12 |
| 10 | MAGLALQPG (SEQ ID NO: 5189) | 12 |
| 27 | KAQVSNEDC (SEQ ID NO: 5190) | 12 |
| 30 | VSNEDCLQV (SEQ ID NO: 5191) | 12 |
| 93 | NASGAHALQ (SEQ ID NO: 5192) | 12 |
| 103 | AAAILALLP (SEQ ID NO: 5193) | 12 |
| 104 | AAILALLPA (SEQ ID NO: 5194) | 12 |

TABLE XXXIIII

V19-HLA-B5101-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | GPMPCSRLL (SEQ ID NO: 5195) | 17 |
| 3 | MPCSRLLPS (SEQ ID NO: 5196) | 13 |
| 9 | LPSLRCSLH (SEQ ID NO: 5197) | 12 |
| 8 | LLPSLRCSL (SEQ ID NO: 5198) | 9 |

TABLE XXXIIII

V20-HLA-B5101-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 5 | DPASSRLWG (SEQ ID NO: 5199) | 16 |
| 3 | SGDPASSRL (SEQ ID NO: 5200) | 13 |
| 6 | PASSRLWGA (SEQ ID NO: 5201) | 11 |

TABLE XXXIIII

V21-HLA-B5101-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 9 | DPAQWEPVL (SEQ ID NO: 5202) | 23 |
| 1 | QASVPLLTD (SEQ ID NO: 5203) | 14 |
| 4 | VPLLTDPAQ (SEQ ID NO: 5204) | 14 |
| 8 | TDPAQWEPV (SEQ ID NO: 5205) | 11 |

TABLE XXXIIII

V21&22-HLA-B5101-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | VPLLTDLAQ (SEQ ID NO: 5206) | 15 |
| 8 | DLAQWEPVL (SEQ ID NO: 5207) | 13 |
| 7 | TDLAQWEPV (SEQ ID NO: 5208) | 12 |
| 1 | ASVPLLTDL (SEQ ID NO: 5209) | 8 |

TABLE XXXIIII

V22-HLA-B5101-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 9 | LAQWEPVLV (SEQ ID NO: 5210) | 22 |
| 3 | VPLLTHLAQ (SEQ ID NO: 5211) | 15 |
| 7 | THLAQWEPV (SEQ ID NO: 5212) | 12 |

TABLE XXXIIII

V24-HLA-B5101-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | LTMYVCTPV (SEQ ID NO: 5213) | 13 |
| 4 | TMYVCTPVP (SEQ ID NO: 5214) | 8 |
| 6 | YVCTPVPHP (SEQ ID NO: 5215) | 6 |

TABLE XXXIIII

V25-HLA-B5101-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 3 | TPTRQISSI (SEQ ID NO: 5216) | 22 |

TABLE XXXIIII

V25&26-HLA-B5101-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | TPTRQISSS (SEQ ID NO: 5217) | 12 |

TABLE XXXIIII

V26-HLA-B5101-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 1 | TPTRQIGSS (SEQ ID NO: 5218) | 12 |
| 6 | IGSSDTDPP (SEQ ID NO: 5219) | 8 |

TABLE XXXIIII

V27-HLA-B5101-9mers-PSCA
Each peptide is a portion of SEQ ID NO: 8; each start position is specified, the length of peptide is 9 amino acids, and the end position for each peptide is the start position plus eight.

| Pos | 123456789 | score |
|---|---|---|
| 2 | RGQALRRAQ (SEQ ID NO: 5220) | 8 |
| 1 | SRGQALRRA (SEQ ID NO: 5221) | 3 |

TABLE XXXIV

V1-HLA-A1-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 15 | LQPGTALLCY (SEQ ID NO: 5222) | 22 |
| 37 | QVENCTQLGE (SEQ ID NO: 5223) | 16 |
| 88 | DTDLCNASGA (SEQ ID NO: 5224) | 16 |
| 68 | LNCVDDSQDY (SEQ ID NO: 5225) | 15 |
| 69 | NCVDDSQDYY (SEQ ID NO: 5226) | 15 |
| 74 | SQDYYVGKKN (SEQ ID NO: 5227) | 15 |
| 108 | ALLPALGLLL (SEQ ID NO: 5228) | 15 |

TABLE XXXIV-continued

V1-HLA-A1-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 14 | ALQPGTALLC (SEQ ID NO: 5229) | 14 |
| 31 | SNEDCLQVEN (SEQ ID NO: 5230) | 12 |
| 71 | VDDSQDYYVG (SEQ ID NO: 5231) | 12 |
| 84 | ITCCDTDLCN (SEQ ID NO: 5232) | 12 |
| 99 | ALQPAAAILA (SEQ ID NO: 5233) | 12 |
| 32 | NEDCLQVENC (SEQ ID NO: 5234) | 11 |
| 44 | LGEQCWTARI (SEQ ID NO: 5235) | 10 |
| 51 | ARIRAVGLLT (SEQ ID NO: 5236) | 10 |
| 70 | CVDDSQDYYV (SEQ ID NO: 5237) | 10 |
| 86 | CCDTDLCNAS (SEQ ID NO: 5238) | 10 |

TABLE XXXIV

V4-HLA-A1-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 104 | HPDPPMALSR (SEQ ID NO: 5239) | 20 |
| 123 | DTDPPADGPS (SEQ ID NO: 5240) | 20 |
| 46 | SGDPASYRLW (SEQ ID NO: 5241) | 18 |

TABLE XXXIV-continued

V4-HLA-A1-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 88 | AHPNASLTMY (SEQ ID NO: 5242) | 17 |
| 43 | ACCSGDPASY (SEQ ID NO: 5243) | 16 |
| 79 | QWEPVLVPEA (SEQ ID NO: 5244) | 15 |
| 157 | QEAFPAHPIY (SEQ ID NO: 5245) | 15 |
| 127 | PADGPSNPLC (SEQ ID NO: 5246) | 14 |
| 85 | VPEAHPNASL (SEQ ID NO: 5247) | 12 |
| 121 | SIDTDPPADG (SEQ ID NO: 5248) | 12 |
| 144 | FSTLNPVLRH (SEQ ID NO: 5249) | 12 |
| 25 | GPMPCSRLPP (SEQ ID NO: 5250) | 11 |
| 128 | ADGPSNPLCC (SEQ ID NO: 5251) | 11 |
| 165 | IYDLSQVWSV (SEQ ID NO: 5252) | 11 |
| 29 | CSRLPPSLRC (SEQ ID NO: 5253) | 10 |
| 74 | LTHPAQWEPV (SEQ ID NO: 5254) | 10 |
| 87 | EAHPNASLTM (SEQ ID NO: 5255) | 10 |
| 112 | SRTPTRQIGS (SEQ ID NO: 5256) | 10 |
| 115 | PTRQIGSIDT (SEQ ID NO: 5257) | 10 |
| 156 | PQEAFPAHPI (SEQ ID NO: 5258) | 10 |

TABLE XXXIV-continued

V4-HLA-A1-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 161 | PAHPIYDLSQ (SEQ ID NO: 5259) | 10 |
| 66 | VPQASVPLLT (SEQ ID NO: 5260) | 9 |
| 69 | ASVPLLTHPA (SEQ ID NO: 5261) | 9 |

TABLE XXXIV

V19-HLA-A1-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 2 | GPMPCSRLLP (SEQ ID NO: 5262) | 13 |
| 6 | CSRLLPSLRC (SEQ ID NO: 5263) | 10 |
| 3 | PMPCSRLLPS (SEQ ID NO: 5264) | 6 |
| 8 | RLLPSLRCSL (SEQ ID NO: 5265) | 6 |
| 10 | LPSLRCSLHS (SEQ ID NO: 5266) | 6 |

TABLE XXXIV

V20-HLA-A1-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 4 | SGDPASSRLW (SEQ ID NO: 5267) | 18 |

TABLE XXXIV-continued

V20-HLA-A1-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 9 | SSRLWGAPLQ (SEQ ID NO: 5268) | 8 |
| 10 | SRLWGAPLQP (SEQ ID NO: 5269) | 8 |

TABLE XXXIV

V21-HLA-A1-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 8 | LTDPAQWEPV (SEQ ID NO: 5270) | 20 |
| 3 | ASVPLLTDPA (SEQ ID NO: 5271) | 9 |

TABLE XXXIV

V21&22-HLA-A1-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 7 | LTDLAQWEPV (SEQ ID NO: 5272) | 16 |
| 2 | ASVPLLTDLA (SEQ ID NO: 5273) | 11 |
| 3 | SVPLLTDLAQ (SEQ ID NO: 5274) | 8 |

TABLE XXXIV

V22-HLA-A1-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 2 | ASVPLLTHLA (SEQ ID NO: 5275) | 11 |
| 3 | SVPLLTHLAQ (SEQ ID NO: 5276) | 8 |
| 10 | LAQWEPVLVP (SEQ ID NO: 5277) | 8 |
| 7 | LIHLAQWEPV (SEQ ID NO: 5278) | 6 |

TABLE XXXIV

V24-HLA-A1-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 4 | LTMYVCTPVP (SEQ ID NO: 5279) | 7 |
| 2 | ASLTMYVCTP (SEQ ID NO: 5280) | 6 |
| 9 | CIPVPHEDPP (SEQ ID NO: 5281) | 6 |
| 8 | VCTPVPHPDP (SEQ ID NO: 5282) | 5 |
| 10 | TPVPHPDPPM (SEQ ID NO: 5283) | 4 |
| 3 | SLTMYVCTPV (SEQ ID NO: 5284) | 3 |

TABLE XXXIV

V25-HLA-A1-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 2 | SRTPTRQISS (SEQ ID NO: 5285) | 10 |
| 5 | PIRQISSIDT (SEQ ID NO: 5286) | 10 |
| 3 | RIPTRQISSI (SEQ ID NO: 5287) | 6 |
| 10 | SSIDTDPPAD (SEQ ID NO: 5288) | 6 |
| 1 | LSRTPTRQIS (SEQ ID NO: 5289) | 5 |
| 9 | ISSIDTDPPA (SEQ ID NO: 5290) | 4 |

TABLE XXXIV

V25&26-HLA-A1-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 1 | RTPTRQISSS (SEQ ID NO: 5291) | 6 |
| 3 | PTRQISSSDT (SEQ ID NO: 5292) | 6 |
| 8 | SSSDTDPPAD (SEQ ID NO: 5293) | 6 |
| 7 | ISSSDTDPPA (SEQ ID NO: 5294) | 4 |

TABLE XXXIV

V26-HLA-A1-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 9 | SSDTDPPADG (SEQ ID NO: 5295) | 16 |

TABLE XXXIV

V27-HLA-A1-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 1 | PSRGQALRRA (SEQ ID NO: 5296) | 5 |
| 2 | SRGQALRRAQ (SEQ ID NO: 5297) | 3 |

TABLE XXXV

V1-HLA-A0201-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 108 | ALLPALGLLL (SEQ ID NO: 5298) | 27 |
| 4 | VLLALLMAGL (SEQ ID NO: 5299) | 26 |
| 106 | ILALLPALGL (SEQ ID NO: 5300) | 26 |
| 52 | RIRAVGLLTV (SEQ ID NO: 5301) | 25 |
| 12 | GLALQPGTAL (SEQ ID NO: 5302) | 24 |
| 104 | AAILALLPAL (SEQ ID NO: 5303) | 24 |

TABLE XXXV-continued

V1-HLA-A0201-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 21 | LLCYSCKAQV (SEQ ID NO: 5304) | 23 |
| 114 | GLLLWGPGQL (SEQ ID NO: 5305) | 23 |
| 107 | LALLPALGLL (SEQ ID NO: 5306) | 22 |
| 6 | LALLMAGLAL (SEQ ID NO: 5307) | 20 |
| 7 | ALLMAGLALQ (SEQ ID NO: 5308) | 20 |
| 13 | LALQPGTALL (SEQ ID NO: 5309) | 20 |
| 35 | CLQVENCTQL (SEQ ID NO: 5310) | 20 |
| 49 | WTARIRAVGL (SEQ ID NO: 5311) | 19 |
| 5 | LLALLMAGLA (SEQ ID NO: 5312) | 18 |
| 9 | LMAGLALQPG (SEQ ID NO: 5313) | 18 |
| 50 | TARIRAVGLL (SEQ ID NO: 5314) | 18 |
| 59 | LTVISKGCSL (SEQ ID NO: 5315) | 18 |
| 62 | ISKGCSLNCV (SEQ ID NO: 5316) | 18 |
| 98 | HALQPAAAIL (SEQ ID NO: 5317) | 18 |
| 99 | ALQPAAAILA (SEQ ID NO: 5318) | 18 |
| 100 | LQPAAAILAL (SEQ ID NO: 5319) | 18 |
| 101 | QPAAAILALL (SEQ ID NO: 5320) | 18 |
| 103 | AAAILALLPA (SEQ ID NO: 5321) | 17 |
| 109 | LLPALGLLLW (SEQ ID NO: 5322) | 17 |
| 47 | QCWTARIRAV (SEQ ID NO: 5323) | 16 |
| 53 | IRAVGLLTVI (SEQ ID NO: 5324) | 16 |
| 70 | CVDDSQDYYV (SEQ ID NO: 5325) | 16 |
| 14 | ALQPGIALLC (SEQ ID NO: 5326) | 15 |
| 27 | KAQVSNEDCL (SEQ ID NO: 5327) | 15 |
| 29 | QVSNESCLQV (SEQ ID NO: 5328) | 15 |
| 90 | DLCNASGAHA (SEQ ID NO: 5329) | 15 |
| 91 | LCNASGAHAL (SEQ ID NO: 5330) | 15 |
| 97 | AHALQPAAAI (SEQ ID NO: 5331) | 15 |
| 2 | KAVLLALLMA (SEQ ID NO: 5332) | 14 |
| 8 | LLMAGLALQP (SEQ ID NO: 5333) | 14 |
| 20 | ALLCYSCKAQ (SEQ ID NO: 5334) | 14 |
| 105 | AILALLPALG (SEQ ID NO: 5335) | 14 |
| 3 | AVLLALLMAG (SEQ ID NO: 5336) | 13 |
| 43 | QLGEQCWTAR (SEQ ID NO: 5337) | 13 |

TABLE XXXV-continued

V1-HLA-A0201-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 57 | GLLTVISKGC (SEQ ID NO: 5338) | 13 |
| 67 | SLNCVDDSQD (SEQ ID NO: 5339) | 13 |
| 82 | KNITCCDTDL (SEQ ID NO: 5340) | 13 |

TABLE XXXV

V4-HLA-A0201-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 31 | RLPPSLRCSL (SEQ ID NO: 5341) | 24 |
| 62 | TLGVVPQASV (SEQ ID NO: 5342) | 24 |
| 93 | SLTMYVCAPV (SEQ ID NO: 5343) | 23 |
| 145 | STLNPVLRHL (SEQ ID NO: 5344) | 22 |
| 53 | RLWGAPLQPT (SEQ ID NO: 5345) | 21 |
| 65 | VVPQASVPLL (SEQ ID NO: 5346) | 20 |
| 110 | ALSRTPTRQI (SEQ ID NO: 5347) | 20 |
| 64 | GVVPQASVPL (SEQ ID NO: 5348) | 19 |
| 57 | APLQPTLGVV (SEQ ID NO: 5349) | 18 |
| 74 | LTHPAQWEPV (SEQ ID NO: 5350) | 18 |

TABLE XXXV-continued

V4-HLA-A0201-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 83 | VLVPEAHPNA (SEQ ID NO: 5351) | 18 |
| 113 | RTPTRQIGSI (SEQ ID NO: 5352) | 18 |
| 165 | IYDLSQVWSV (SEQ ID NO: 5353) | 18 |
| 56 | GAPLQPTLGV (SEQ ID NO: 5354) | 17 |
| 141 | GPAFSTLNPV (SEQ ID NO: 5355) | 17 |
| 150 | VLRHLFPQEA (SEQ ID NO: 5356) | 17 |
| 153 | HLFPQEAFPA (SEQ ID NO: 5357) | 17 |
| 159 | AFPAHPIYDL (SEQ ID NO: 5358) | 17 |
| 176 | SPAPSRGQAL (SEQ ID NO: 5359) | 17 |
| 162 | AHPIYDLSQV (SEQ ID NO: 5360) | 16 |
| 50 | ASYRLWGAPL (SEQ ID NO: 5361) | 15 |
| 54 | LWGAPLQPTL (SEQ ID NO: 5362) | 15 |
| 76 | HPAQWEPVLV (SEQ ID NO: 5363) | 14 |
| 85 | VPEAHPNASL (SEQ ID NO: 5364) | 14 |
| 102 | VPHPDEPMAL (SEQ ID NO: 5365) | 14 |
| 138 | CFHGPAFSTL (SEQ ID NO: 5366) | 14 |
| 146 | TLNPVLRHLF (SEQ ID NO: 5367) | 14 |

TABLE XXXV-continued

V4-HLA-A0201-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 166 | YDLSQMWSVV (SEQ ID NO: 5368) | 14 |
| 7 | TWARRTSRAV (SEQ ID NO: 5369) | 13 |
| 23 | PAGPMPCSRL (SEQ ID NO: 5370) | 13 |
| 27 | MPCSRLPPSL (SEQ ID NO: 5371) | 13 |
| 35 | SLRCSLHSAC (SEQ ID NO: 5372) | 13 |
| 39 | SLHSACCSGD (SEQ ID NO: 5373) | 13 |
| 73 | LLTHPAQWEP (SEQ ID NO: 5374) | 13 |
| 142 | PAFSTLNPVL (SEQ ID NO: 5375) | 13 |
| 45 | CSGDPASYRL (SEQ ID NO: 5376) | 12 |
| 79 | QWEPVLVPEA (SEQ ID NO: 5377) | 12 |
| 121 | SIDTDPPADG (SEQ ID NO: 5378) | 12 |
| 15 | AVTPTCATPA (SEQ ID NO: 5379) | 11 |
| 58 | PLQPTLGVVP (SEQ ID NO: 5380) | 11 |
| 75 | THPAQWEPVL (SEQ ID NO: 5381) | 11 |
| 78 | AQWEPVLVPE (SEQ ID NO: 5382) | 11 |
| 89 | HPNASLTMYV (SEQ ID NO: 5383) | 11 |
| 95 | TMYVCAPVPH (SEQ ID NO: 5384) | 11 |

TABLE XXXV-continued

V4-HLA-A0201-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 126 | PPADGPSNPL (SEQ ID NO: 5385) | 11 |
| 134 | PLCCCFHGPA (SEQ ID NO: 5386) | 11 |
| 167 | DLSQVWSVVS (SEQ ID NO: 5387) | 11 |

TABLE XXXV

V19-HLA-A0201-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 8 | RLLPSLRCSL (SEQ ID NO: 5388) | 26 |
| 4 | MPCSRLLPSL (SEQ ID NO: 5389) | 17 |
| 1 | AGPMPCSRLL (SEQ ID NO: 5390) | 12 |
| 9 | LLPSLRCSLH (SEQ ID NO: 5391) | 12 |

TABLE XXXV

V21-HLA-A0201-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 8 | LTDPAQWEPV (SEQ ID NO: 5396) | 18 |
| 7 | LLTDPAQWEP (SEQ ID NO: 5397) | 14 |

TABLE XXXV-continued

V21-HLA-A0201-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 10 | DPAQWEPVLV (SEQ ID NO: 5398) | 13 |
| 9 | TDPAQWEPVL (SEQ ID NO: 5399) | 11 |
| 6 | PLLTDPAQWE (SEQ ID NO: 5400) | 9 |
| 2 | QASVPLLTDP (SEQ ID NO: 5401) | 8 |
| 3 | ASVPLLTDPA (SEQ ID NO: 5402) | 8 |
| 4 | SVPLLTDPAQ (SEQ ID NO: 5403) | 8 |

TABLE XXXV

V21&22-HLA-A0201-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 9 | DLAQWEPVLV (SEQ ID NO: 5404) | 23 |
| 1 | QASVPLLTDL (SEQ ID NO: 5405) | 18 |
| 7 | LTDLAQWEPV (SEQ ID NO: 5406) | 16 |
| 6 | LLTDLAQWEP (SEQ ID NO: 5407) | 14 |
| 8 | TDLAQWEPVL (SEQ ID NO: 5408) | 13 |

TABLE XXXV

V22-HLA-A0201-10mers-PSCA
Each peptide is a portion of SEQ ID NO: 8; each start position is specified, the length of peptide is 10 amino acids, and the end position for each peptide is the start position plus nine.

| Pos | 123456789 | score |
|---|---|---|
| 9 | HLAQWEPVLV (SEQ ID NO: 5409) | 24 |
| 1 | QASVPLLTHL (SEQ ID NO: 5410) | 18 |
| 7 | LTHLAQWEPV (SEQ ID NO: 5411) | 16 |
| 6 | LLTHLAQWEP (SEQ ID NO: 5412) | 13 |
| 8 | THLAQWEPVL (SEQ ID NO: 5413) | 13 |
| 10 | LAQWEPVLVP (SEQ ID NO: 5414) | 11 |

TABLE XXXV

V24-HLA-A0201-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 3 | SLTMYVCTPV (SEQ ID NO: 5415) | 21 |
| 5 | TMYVCIPVPH (SEQ ID NO: 5416) | 11 |
| 1 | NASLTMYVCT (SEQ ID NO: 5417) | 10 |
| 2 | ASLTMYVCTP (SEQ ID NO: 5418) | 10 |

TABLE XXXV

V25-HLA-A0201-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 3 | RTPTRQISSI (SEQ ID NO: 5419) | 18 |
| 8 | QISSIDTDPP (SEQ ID NO: 5420) | 8 |

TABLE XXXV

V25&26-HLA-A0201-10mers-PSCA
Each peptide is a portion of SEQ ID NO: 8; each start position is specified, the lenght of peptide is 10 amino acids, and the end position for each peptide is the start position plus nine.

| Pos | 1234567890 | score |
|---|---|---|
| 1 | RPTTRQISSS (SEQ ID NO: 5421) | 10 |
| 6 | QISSSDTDPP (SEQ ID NO: 5422) | 8 |
| 7 | ISSSDTDPPA (SEQ ID NO: 5423) | 7 |
| 3 | PTRQISSSDT (SEQ ID NO: 5424) | 5 |
| 8 | SSSDTDPPAD (SEQ ID NO: 5425) | 5 |

TABLE XXXV

V26-HLA-A0201-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 1 | RTPTRQIGSS (SEQ ID NO: 5426) | 10 |
| 6 | QIGSSDTDPP (SEQ ID NO: 5427) | 8 |

TABLE XXXV-continued

V26-HLA-A0201-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 7 | IGSSDTDPPA (SEQ ID NO: 5428) | 7 |
| 3 | PTRQIGSSDT (SEQ ID NO: 5429) | 5 |
| 5 | RQIGSSDTDP (SEQ ID NO: 5430) | 4 |
| 8 | GSSDTDPPAD (SEQ ID NO: 5431) | 4 |
| 9 | SSDTDPPADG (SEQ ID NO: 5432) | 4 |

TABLE XXXV

V27-HLA-A0201-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 1 | PSRGQALRRA (SEQ ID NO: 5433) | 7 |
| 2 | SRGQALRRAQ (SEQ ID NO: 5434) | 3 |

TABLE XXXVI

V1-HLA-A0203-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 96 | GAHALQPAAA (SEQ ID NO: 5435) | 27 |
| 95 | SGAHALQPAA (SEQ ID NO: 5436) | 19 |

TABLE XXXVI-continued

V1-HLA-A0203-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 90 | DLCNASGAHA (SEQ ID NO: 5437) | 18 |
| 97 | AHALQPAAAI (SEQ ID NO: 5438) | 17 |

TABLE XXXVI

V4-HLA-A0203-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 6 | TTWARRTSRA (SEQ ID NO: 5439) | 10 |
| 12 | TSRAVTPTCA (SEQ ID NO: 5440) | 10 |
| 15 | AVTPTCATPA (SEQ ID NO: 5441) | 10 |
| 34 | PSLRCSLHSA (SEQ ID NO: 5442) | 10 |
| 41 | HSACCSGDPA (SEQ ID NO: 5443) | 10 |
| 48 | DPASYRLWGA (SEQ ID NO: 5444) | 10 |
| 60 | QPTLGVVPQA (SEQ ID NO: 5445) | 10 |
| 69 | ASVPLLTHPA (SEQ ID NO: 5446) | 10 |
| 79 | QWEPVLYPEA (SEQ ID NO: 5447) | 10 |
| 83 | VLVPEAHPNA (SEQ ID NO: 5448) | 10 |
| 91 | NASLTMYVCA (SEQ ID NO: 5449) | 10 |

TABLE XXXVI-continued

V4-HLA-A0203-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 101 | PVPHPDPPMA (SEQ ID NO: 5450) | 10 |
| 119 | IGSIDTDPPA (SEQ ID NO: 5451) | 10 |
| 134 | PLCCCFHGPA (SEQ ID NO: 5452) | 10 |
| 150 | VLRHLFPQEA (SEQ ID NO: 5453) | 10 |
| 153 | HLFPQEAFPA (SEQ ID NO: 5454) | 10 |
| 169 | SQVWSVVSPA (SEQ ID NO: 5455) | 10 |
| 175 | VSPAPSRGQA (SEQ ID NO: 5456) | 10 |
| 179 | PSRGQALRRA (SEQ ID NO: 5457) | 10 |
| 1 | MTHRTTTWAR (SEQ ID NO: 5458) | 9 |
| 7 | TWARRTSRAV (SEQ ID NO: 5459) | 9 |
| 13 | SRAVTPICAT (SEQ ID NO: 5460) | 9 |
| 16 | VIPTCAIPAG (SEQ ID NO: 5461) | 9 |
| 35 | SLRCSLHSAC (SEQ ID NO: 5462) | 9 |
| 42 | SACCSGDPAS (SEQ ID NO: 5463) | 9 |
| 49 | PASYRLWGAP (SEQ ID NO: 5464) | 9 |
| 61 | PTLGVVPQAS (SEQ ID NO: 5465) | 9 |
| 70 | SVPLLTHPAQ (SEQ ID NO: 5466) | 9 |

TABLE XXXVI-continued

V4-HLA-A0203-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 80 | WEPVLVEEAH (SEQ ID NO: 5467) | 9 |
| 84 | LVPEAHRNAS (SEQ ID NO: 5468) | 9 |
| 92 | ASLTMYMCAP (SEQ ID NO: 5469) | 9 |
| 102 | VEHPDPEMAL (SEQ ID NO: 5470) | 9 |
| 120 | GSIDTDPPAD (SEQ ID NO: 5471) | 9 |
| 135 | LCCCFHGPAF (SEQ ID NO: 5472) | 9 |
| 151 | LRHLFPQEAF (SEQ ID NO: 5473) | 9 |
| 154 | LFPQEAFPAH (SEQ ID NO: 5474) | 9 |
| 170 | QVWSWSPAPL (SEQ ID NO: 5475) | 9 |
| 176 | SPAPSRGQAL (SEQ ID NO: 5476) | 9 |
| 180 | SRGQALPRAR (SEQ ID NO: 5477) | 9 |
| 2 | THRTTTWARR (SEQ ID NO: 5478) | 8 |
| 8 | WARRTSRAVT (SEQ ID NO: 5479) | 8 |
| 14 | RAVTPTCATP (SEQ ID NO: 5480) | 8 |
| 17 | TETCATPAGP (SEQ ID NO: 5481) | 8 |
| 36 | LRCSLHSACC (SEQ ID NO: 5482) | 8 |
| 43 | ACCSGDPASY (SEQ ID NO: 5483) | 8 |

TABLE XXXVI-continued

V4-HLA-A0203-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 50 | ASYRLWGAPL (SEQ ID NO: 5484) | 8 |
| 62 | TLGVVPQASV (SEQ ID NO: 5485) | 8 |
| 71 | VPLLTHPAQW (SEQ ID NO: 5486) | 8 |
| 81 | EPVLVPEAHP (SEQ ID NO: 5487) | 8 |
| 85 | VPEAHPNASL (SEQ ID NO: 5488) | 8 |
| 93 | SLTMYVCAPV (SEQ ID NO: 5489) | 8 |
| 103 | PHPDPPMALS (SEQ ID NO: 5490) | 8 |
| 121 | SIDTDPPADG (SEQ ID NO: 5491) | 8 |
| 136 | CCCFHGEAFS (SEQ ID NO: 5492) | 8 |
| 152 | RHLFPQEAFP (SEQ ID NO: 5493) | 8 |
| 155 | FPQEAFPAHP (SEQ ID NO: 5494) | 8 |
| 171 | VWSVVSPAPS (SEQ ID NO: 5495) | 8 |
| 177 | PAPSRGQALR (SEQ ID NO: 5496) | 8 |

TABLE XXXVI

V19-HLA-A0203-10mers-PSCA

| Pos | 1234567890 | score |
|---|---|---|
| | NoResultsFound. | |

TABLE XXXVI

V20-HLA-A0203-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 6 | DPASSRLWGA (SEQ ID NO: 5497) | 10 |
| 7 | PASSRLWGAP (SEQ ID NO: 5498) | 9 |
| 1 | ACCSGDPASS (SEQ ID NO: 5499) | 8 |
| 8 | ASSRLWGAPL (SEQ ID NO: 5500) | 8 |

TABLE XXXVI

V21-HLA-A0203-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 3 | ASVPLLTDPA (SEQ ID NO: 5501) | 10 |
| 4 | SVPLLTDPAQ (SEQ ID NO: 5502) | 9 |
| 5 | VELLTDPAQW (SEQ ID NO: 5503) | 8 |

TABLE XXXVI

V21&22-HLA-A0203-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 2 | ASVPLLTDLA (SEQ ID NO: 5504) | 10 |
| 3 | SVPLLTDLAQ (SEQ ID NO: 5505) | 9 |

TABLE XXXVI-continued

V21&22-HLA-A0203-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 4 | VPLLTDLAQW (SEQ ID NO: 5506) | 8 |

TABLE XXXVI

V22-HLA-A0203-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 2 | ASVPLLTHLA (SEQ ID NO: 5507) | 10 |
| 3 | SVPLLTHLAQ (SEQ ID NO: 5508) | 9 |
| 4 | VPLLTHLAQW (SEQ ID NO: 5509) | 8 |

TABLE XXXVI

V24-HLA-A0203-10mers-PSCA

| Pos | 1234567890 | score |
|---|---|---|
| NoResultsFound. | | |

TABLE XXXVI

V25-HLA-A0203-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 9 | ISSIDTDPPA (SEQ ID NO: 5510) | 10 |
| 10 | SSIDTDPPAD (SEQ ID NO: 5511) | 9 |

TABLE XXXVI

V25&28-HLA-A0203-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 7 | ISSSDTDPPA (SEQ ID NO: 5512) | 10 |
| 8 | SSSDTDPPAD (SEQ ID NO: 5513) | 9 |

TABLE XXXVI

V26-HLA-A0203-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 7 | IGSSDTDPPA (SEQ ID NO: 5514) | 10 |
| 8 | GSSDTDRPAD (SEQ ID NO: 5515) | 9 |
| 9 | SSDTDPPADG (SEQ ID NO: 5516) | 8 |

TABLE XXXVI

V27-HLA-A0203-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 1 | PSRGQALRRA (SEQ ID NO: 5517) | 10 |
| 2 | SRGQALRRAQ (SEQ ID NO: 5518) | 9 |

TABLE XXXVII

V1-HLA-A3-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 55 | AVGLLTVISK (SEQ ID NO: 5519) | 26 |
| 52 | RIRAVGLLTV (SEQ ID NO: 5520) | 24 |
| 108 | ALLPALGLLL (SEQ ID NO: 5521) | 24 |
| 14 | ALQPGTALLC (SEQ ID NO: 5522) | 22 |
| 8 | LLMAGLALQP (SEQ ID NO: 5523) | 21 |
| 106 | ILALLPALGL (SEQ ID NO: 5524) | 20 |
| 29 | QVSNEDCLQV (SEQ ID NO: 5525) | 19 |
| 43 | QLGEQCWTAR (SEQ ID NO: 5526) | 19 |
| 99 | ALQPAAAILA (SEQ ID NO: 5527) | 19 |
| 105 | AILALLPALG (SEQ ID NO: 5528) | 19 |
| 3 | AVLLALLMAG (SEQ ID NO: 5529) | 18 |
| 7 | ALLMAGLALQ (SEQ ID NO: 5530) | 18 |
| 114 | GLLLWGPGQL (SEQ ID NO: 5531) | 18 |
| 4 | VLLALLMAGL (SEQ ID NO: 5532) | 17 |
| 12 | GLALQPGTAL (SEQ ID NO: 5533) | 17 |
| 67 | SLNCVDDSQD (SEQ ID NO: 5534) | 17 |
| 90 | DLCNASGAHA (SEQ ID NO: 5535) | 17 |

TABLE XXXVII-continued

V1-HLA-A3-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 5 | LLALLMAGLA (SEQ ID NO: 5536) | 16 |
| 20 | ALLCYSCKAQ (SEQ ID NO: 5537) | 16 |
| 21 | LLCYSCKAQV (SEQ ID NO: 5538) | 16 |
| 37 | QVENCTQLGE (SEQ ID NO: 5539) | 16 |
| 60 | TVISKGCSLN (SEQ ID NO: 5540) | 16 |
| 18 | GTALLCYSCK (SEQ ID NO: 5541) | 15 |
| 51 | ARIRAVGLLT (SEQ ID NO: 5542) | 15 |
| 109 | LLPALGLLLW (SEQ ID NO: 5543) | 15 |
| 112 | ALGLLLWGPG (SEQ ID NO: 5544) | 15 |
| 35 | CLQVENCTQL (SEQ ID NO: 5545) | 14 |
| 72 | DDSQDYYVGK (SEQ ID NO: 5546) | 14 |
| 11 | AGLALQPGTA (SEQ ID NO: 5547) | 13 |
| 57 | GLLTVISKGC (SEQ ID NO: 5548) | 12 |
| 73 | DSQDYYVGKK (SEQ ID NO: 5549) | 12 |
| 97 | AHALQPAAAI (SEQ ID NO: 5550) | 12 |

TABLE XXXVII

V4-HLA-A3-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 58 | PLQPTLGVVP (SEQ ID NO: 5551) | 24 |
| 15 | AVTPTCATPA (SEQ ID NO: 5552) | 20 |
| 31 | RLPPSLRCSL (SEQ ID NO: 5553) | 20 |
| 110 | ALSRTPTRQI (SEQ ID NO: 5554) | 19 |
| 35 | SLRCSLHSAC (SEQ ID NO: 5555) | 18 |
| 146 | TLNPVLRHLF (SEQ ID NO: 5556) | 18 |
| 149 | PVLRHLFPQE (SEQ ID NO: 5557) | 18 |
| 164 | PIYDLSQVWS (SEQ ID NO: 5558) | 18 |
| 167 | DLSQVWSVVS (SEQ ID NO: 5559) | 18 |
| 9 | ARRTSRAVTP (SEQ ID NO: 5560) | 17 |
| 64 | GVVPQASVPL (SEQ ID NO: 5561) | 17 |
| 50 | ASYRLWGAPL (SEQ ID NO: 5562) | 16 |
| 53 | RLWGAPLQPT (SEQ ID NO: 5563) | 16 |
| 72 | PLLTHPAQWE (SEQ ID NO: 5564) | 16 |
| 153 | HLFPQEAFPA (SEQ ID NO: 5565) | 16 |
| 178 | APSRGQALRR (SEQ ID NO: 5566) | 16 |
| 43 | ACCSGDPASY (SEQ ID NO: 5567) | 15 |

TABLE XXXVII-continued

V4-HLA-A3-10mers-PSCA
Each peptide is a portion of SEQ ID NO: 8;
each start position is specified, the
length of peptide is 10 amino acids, and
the end position for each peptide is the
start position plus nine.

| Pos | 1234567890 | score |
|---|---|---|
| 62 | TLGVVPQASV (SEQ ID NO: 5568) | 15 |
| 82 | PVLPEAHPN (SEQ ID NO: 5569) | 15 |
| 104 | HPDPPMALSR (SEQ ID NO: 5570) | 15 |
| 173 | SVVSPAPSRG (SEQ ID NO: 5571) | 15 |
| 8 | WARRTSRAVT (SEQ ID NO: 5572) | 14 |
| 39 | SLHSACCSGD (SEQ ID NO: 5573) | 14 |
| 93 | SLTMYVCAPV (SEQ ID NO: 5574) | 14 |
| 150 | VLRHLFPQEA (SEQ ID NO: 5575) | 14 |
| 70 | SVPLLTHPAQ (SEQ ID NO: 5576) | 13 |
| 83 | VLVPEAHPNA (SEQ ID NO: 5577) | 13 |
| 84 | LVPEAHPNAS (SEQ ID NO: 5578) | 13 |
| 95 | TMYVCAPVPH (SEQ ID NO: 5579) | 13 |
| 97 | YVCAPVPHPD (SEQ ID NO: 5580) | 13 |
| 121 | SIDTDPPADG (SEQ ID NO: 5581) | 13 |
| 170 | QVWSVVSPAP (SEQ ID NO: 5582) | 13 |
| 174 | VVSPAPSRGQ (SEQ ID NO: 5583) | 13 |
| 44 | CCSGDPASYR (SEQ ID NO: 5584) | 12 |

TABLE XXXVII-continued

V4-HLA-A3-10mers-PSCA
Each peptide is a portion of SEQ ID NO: 8;
each start position is specified, the
length of peptide is 10 amino acids, and
the end position for each peptide is the
start position plus nine.

| Pos | 1234567890 | score |
|---|---|---|
| 67 | PQASVPLLTH (SEQ ID NO: 5585) | 12 |
| 88 | AHPNASLTMY (SEQ ID NO: 5586) | 12 |
| 101 | PVPHPDPPMA (SEQ ID NO: 5587) | 12 |
| 143 | AFSTLNPVLR (SEQ ID NO: 5588) | 12 |
| 11 | RTSRAVTPTC (SEQ ID NO: 5589) | 11 |
| 14 | RAVTPTCATP (SEQ ID NO: 5590) | 11 |
| 28 | PCSRLPPSLR (SEQ ID NO: 5591) | 11 |
| 134 | PLCCCFHGPA (SEQ ID NO: 5592) | 11 |

TABLE XXXVII

V19-HLA-A3-10mers-PSCA
Each peptide is a portion
of SEQ ID NO: 8; each
start position is specified,
the length of peptide is 10
amino acids, and the end
position for each peptide
is the start position plus
nine.

| Pos | 1234567890 | score |
|---|---|---|
| 8 | RLLPSLRCSL (SEQ ID NO: 5593) | 22 |
| 9 | LLESLRCSLH (SEQ ID NO: 5594) | 17 |
| 5 | PCSRLLPSLR (SEQ ID NO: 5595) | 11 |

TABLE XXXVII

V20-HLA-A3-10mers-PSCA
Each peptide is a portion of
SEQ ID NO: 8; each start
position is specified, the
length of peptide is 10
amino acids, and the end
position for each peptide is
the start position plus nine.

| Pos | 1234567890 | score |
|---|---|---|
| 2 | CCSGDPASSR (SEQ ID NO: 5596) | 14 |
| 8 | ASSRLWGAPL (SEQ ID NO: 5597) | 12 |
| 10 | SRLWGAELQP (SEQ ID NO: 5598) | 10 |
| 1 | ACCSGDPASS (SEQ ID NO: 5599) | 9 |
| 9 | SSRLWGAPLQ (SEQ ID NO: 5600) | 8 |
| 5 | GDPASSRLWG (SEQ ID NO: 5601) | 7 |

TABLE XXXVII

V21-HLA-A3-10mers-PSCA
Each peptide is a portion
of SEQ ID NO: 8; each
start position is specified,
the length of peptide is 10
amino acids, and the end
position for each peptide is
the start position plus nine.

| Pos | 1234567890 | score |
|---|---|---|
| 6 | PLLTDPAQWE (SEQ ID NO: 5602) | 16 |
| 4 | SVPLLTDPAQ (SEQ ID NO: 5603) | 13 |
| 7 | LLIDPAQWEP (SEQ ID NO: 5604) | 11 |
| 5 | VPLLTDPAQW (SEQ ID NO: 5605) | 10 |
| 1 | PQASVPLLTD (SEQ ID NO: 5606) | 8 |

TABLE XXXVII

V21&22-HLA-A3-10mers-PSCA
Each peptide is a portion
of SEQ ID NO: 8; each
start position is specified,
the length of peptide is 10
amino acids, and the end
position for each peptide is
the start position plus nine.

| Pos | 1234567890 | score |
|---|---|---|
| 3 | SVPLLTDLAQ (SEQ ID NO: 5607) | 16 |
| 5 | PLLTDLAQWE (SEQ ID NO: 5608) | 16 |
| 9 | DLAQWEPVLV (SEQ ID NO: 5609) | 16 |
| 6 | LLTDLAQWEP (SEQ ID NO: 5610) | 11 |
| 4 | VPLLTDLAQW (SEQ ID NO: 5611) | 9 |
| 8 | TDLAQWEPVL (SEQ ID NO: 5612) | 8 |

TABLE XXXVII

V22-HLA-A3-10mers-PSCA
Each peptide is a portion
of SEQ ID NO: 8; each
start position is specified,
the length of peptide is 10
amino acids, and the end
position for each peptide is
the start position plus nine.

| Pos | 1234567890 | score |
|---|---|---|
| 3 | SVPLLTHLAQ (SEQ ID NO: 5613) | 16 |
| 5 | PLLTHLAQWE (SEQ ID NO: 5614) | 16 |
| 9 | HLAQWEPVLV (SEQ ID NO: 5615) | 16 |
| 6 | LLTHLAQWEP (SEQ ID NO: 5616) | 10 |
| 4 | VPLLTHLAQW (SEQ ID NO: 5617) | 9 |
| 8 | THLAQWEPVL (SEQ ID NO: 5618) | 8 |
| 10 | LAQWEPVLVP (SEQ ID NO: 5619) | 7 |

TABLE XXXVI

V24-HLA-A0203-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 5 | TMYVCTPVPH (SEQ ID NO: 5620) | 13 |
| 3 | SLTMYVCTPV (SEQ ID NO: 5621) | 12 |
| 7 | YVCTPVPHPD (SEQ ID NO: 5622) | 11 |
| 2 | ASLTMYVCTP (SEQ ID NO: 5623) | 9 |

TABLE XXXVI

V25-HLA-A0203-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 8 | QISSIDTDPP (SEQ ID NO: 5624) | 10 |
| 3 | RTPTRQISSI (SEQ ID NO: 5625) | 9 |
| 7 | RQISSIDTDP (SEQ ID NO: 5626) | 8 |
| 10 | SSIDTDPPAD (SEQ ID NO: 5627) | 7 |
| 2 | SRTPTRQISS (SEQ ID NO: 5628) | 6 |
| 4 | TPTRQISSID (SEQ ID NO: 5629) | 6 |
| 6 | TRQISSIDTD (SEQ ID NO: 5630) | 5 |
| 1 | LSRTPTRQIS (SEQ ID NO: 5631) | 4 |

TABLE XXXVI

V25&26-HLA-A0203-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 7 | ISSSDTDPPA (SEQ ID NO: 5632) | 10 |
| 8 | SSSDTDEPAD (SEQ ID NO: 5633) | 9 |

TABLE XXXVII

V26-HLA-A3-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 2 | TPTRQIGSSD (SEQ ID NO: 5634) | 11 |
| 5 | RQIGSSDTDP (SEQ ID NO: 5635) | 10 |
| 6 | QIGSSDTDPP (SEQ ID NO: 5636) | 10 |
| 1 | RTRTRQIGSS (SEQ ID NO: 5637) | 7 |
| 3 | PTRQIGSSDT (SEQ ID NO: 5638) | 6 |
| 4 | TRQIGSSDTD (SEQ ID NO: 5639) | 5 |
| 9 | SSDTDPPADG (SEQ ID NO: 5640) | 5 |
| 10 | SDTDPPADGP (SEQ ID NO: 5641) | 5 |

TABLE XXXVII

V27-HLA-A3-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 1 | PSRGQALRRA (SEQ ID NO: 5642) | 5 |
| 2 | SRGQALRRAQ (SEQ ID NO: 5643) | 3 |

TABLE XXXVIII

V1-HLA-A26-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 59 | LTVISKGCSL (SEQ ID NO: 5644) | 22 |
| 60 | TVISKGCSLN (SEQ ID NO: 5645) | 17 |
| 88 | DTDLCNASGA (SEQ ID NO: 5646) | 17 |
| 104 | AAILALLPAL (SEQ ID NO: 5647) | 17 |
| 49 | WTARIRAVGL (SEQ ID NO: 5648) | 16 |
| 55 | AVGLLTVISK (SEQ ID NO: 5649) | 16 |
| 3 | AVLLALLMAG (SEQ ID NO: 5650) | 15 |
| 15 | LQPGTALLCY (SEQ ID NO: 5651) | 15 |
| 69 | NCVDDSQDYY (SEQ ID NO: 5652) | 15 |
| 73 | DSQDYYVGKK (SEQ ID NO: 5653) | 15 |
| 50 | TARIRAVGLL (SEQ ID NO: 5654) | 14 |

TABLE XXXVIII-continued

V1-HLA-A26-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 78 | YVGKKNITCC (SEQ ID NO: 5655) | 14 |
| 100 | LQPAAAILAL (SEQ ID NO: 5656) | 14 |
| 107 | LALLPALGLL (SEQ ID NO: 5657) | 13 |
| 29 | QVSNEDCLQV (SEQ ID NO: 5658) | 12 |
| 39 | ENCTQLGEQC (SEQ ID NO: 5659) | 12 |
| 82 | KNITCCDTDL (SEQ ID NO: 5660) | 12 |
| 101 | QPAAAILALL (SEQ ID NO: 5661) | 12 |
| 6 | LALLMAGLAL (SEQ ID NO: 5662) | 11 |
| 37 | QVENCTQLGE (SEQ ID NO: 5663) | 11 |
| 46 | EQCWTARIRA (SEQ ID NO: 5664) | 11 |
| 70 | CVDDSQDYYV (SEQ ID NO: 5665) | 11 |
| 108 | ALLPALGLLL (SEQ ID NO: 5666) | 11 |
| 2 | KAVLLALLMA (SEQ ID NO: 5667) | 10 |
| 12 | GLALQPGTAL (SEQ ID NO: 5668) | 10 |
| 33 | EDCLQVENCT (SEQ ID NO: 5669) | 10 |
| 52 | RIRAVGLLTV (SEQ ID NO: 5670) | 10 |
| 68 | LNCVDDSQDY (SEQ ID NO: 5671) | 10 |

TABLE XXXVIII-continued

V1-HLA-A26-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 114 | GLLLWGPGQL (SEQ ID NO: 5672) | 10 |

TABLE XXXVIII

V4-HLA-A26-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 64 | GVVPQASVPL (SEQ ID NO: 5673) | 23 |
| 65 | VVPQASVPLL (SEQ ID NO: 5674) | 22 |
| 145 | STLNPVLRHL (SEQ ID NO: 5675) | 21 |
| 123 | DTDPPADGPS (SEQ ID NO: 5676) | 18 |
| 173 | SVVSPAPSRG (SEQ ID NO: 5677) | 17 |
| 158 | EAFPAHPIYD (SEQ ID NO: 5678) | 16 |
| 88 | AHPNASLTMY (SEQ ID NO: 5679) | 15 |
| 81 | EPVLVPEAHP (SEQ ID NO: 5680) | 14 |
| 113 | RTPTRQIGSI (SEQ ID NO: 5681) | 14 |
| 48 | DPASYRLWGA (SEQ ID NO: 5682) | 13 |
| 84 | LVPEAHPNAS (SEQ ID NO: 5683) | 13 |
| 87 | EAHPNASLTM (SEQ ID NO: 5684) | 13 |

TABLE XXXVIII-continued

V4-HLA-A26-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 129 | DGPSNPLCCC (SEQ ID NO: 5685) | 13 |
| 142 | PAFSTLNPVL (SEQ ID NO: 5686) | 13 |
| 15 | AVTPTCATPA (SEQ ID NO: 5687) | 12 |
| 43 | ACCSGDPASY (SEQ ID NO: 5688) | 12 |
| 70 | SVPLLTHPAQ (SEQ ID NO: 5689) | 12 |
| 159 | AFPAHPIYDL (SEQ ID NO: 5690) | 12 |
| 170 | QVWSVVSPAP (SEQ ID NO: 5691) | 12 |
| 176 | SPAPSRGQAL (SEQ ID NO: 5692) | 12 |
| 5 | TTTWARRTSR (SEQ ID NO: 5693) | 11 |
| 101 | PVPHPDPPMA (SEQ ID NO: 5694) | 11 |
| 149 | PVLRHLFPQE (SEQ ID NO: 5695) | 11 |
| 174 | VVSPAPSRGQ (SEQ ID NO: 5696) | 11 |

TABLE XXXVIII

V19-HLA-A26-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 4 | MPCSRLLPSL (SEQ ID NO: 5697) | 14 |

TABLE XXXVIII-continued

V19-HLA-A26-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 8 | RLLPSLRCSL (SEQ ID NO: 5698) | 10 |
| 1 | AGPMPCSRLL (SEQ ID NO: 5699) | 8 |

TABLE XXXVIII

V20-HLA-A26-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 6 | DPASSRLWGA (SEQ ID NO: 5700) | 13 |
| 3 | CSGDPASSRL (SEQ ID NO: 5701) | 10 |
| 8 | ASSRLWGAPL (SEQ ID NO: 5702) | 9 |

TABLE XXXVIII

V21-HLA-A26-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 4 | SVPLLTDPAQ (SEQ ID NO: 5703) | 12 |
| 8 | LTDPAQWEPV (SEQ ID NO: 5704) | 9 |
| 9 | TDPAQWEPVL (SEQ ID NO: 5705) | 9 |
| 10 | DPAQWEPVLV (SEQ ID NO: 5706) | 8 |
| 1 | PQASVPLLTD (SEQ ID NO: 5707) | 7 |

TABLE XXXVIII-continued

V21-HLA-A26-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 3 | ASVPLLTDPA (SEQ ID NO: 5708) | 5 |

TABLE XXXVIII

V21&V22-HLA-A26-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 3 | SVPLLTDLAQ (SEQ ID NO: 5709) | 13 |
| 1 | QASVPLLTDL (SEQ ID NO: 5710) | 12 |
| 8 | TDLAQWEPVL (SEQ ID NO: 5711) | 9 |
| 7 | LTDLAQWEPV (SEQ ID NO: 5712) | 8 |
| 9 | DLAQWEPVLV (SEQ ID NO: 5713) | 8 |

TABLE XXXVIII

V22-HLA-A26-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 3 | SVPLLTHLAQ (SEQ ID NO: 5714) | 13 |
| 1 | QASVPLLTHL (SEQ ID NO: 5715) | 12 |
| 8 | THLAQWEPVL (SEQ ID NO: 5716) | 9 |
| 7 | LTHLAQWEPV (SEQ ID NO: 5717) | 8 |

TABLE XXXVIII

V24-HLA-A26-10mers-PSCA
Each peptide is a portion of SEQ ID NO: 8;
each start position is specified, the
length of peptide is 10 amino acids, and
the end position for each peptide is the
start position plus nine.

| Pos | 1234567890 | score |
|---|---|---|
| 7 | YVCTPVPHPD (SEQ ID NO: 5718) | 10 |
| 4 | LTMYVCTPVP (SEQ ID NO: 5719) | 8 |
| 6 | MYVCTPVPHP (SEQ ID NO: 5720) | 8 |
| 9 | CTPVPHPDPP (SEQ ID NO: 5721) | 8 |
| 10 | TPVPHPDPPM (SEQ ID NO: 5722) | 6 |
| 2 | ASLTMYVCTP (SEQ ID NO: 5723) | 5 |

TABLE XXXVIII

V25-HLA-A26-10mers-PSCA
Each peptide is a portion of SEQ ID NO: 8;
each start position is specified, the
length of peptide is 10 amino acids, and
the end position for each peptide is the
start position plus nine.

| Pos | 1234567890 | score |
|---|---|---|
| 3 | RTPTRQISSI (SEQ ID NO: 5724) | 14 |
| 5 | PTRQISSIDT (SEQ ID NO: 5725) | 9 |
| 10 | SSIDTDPPAD (SEQ ID NO: 5726) | 7 |
| 6 | TRQISSIDTD (SEQ ID NO: 5727) | 6 |

TABLE XXXVIII

V25&V26-HLA-A26-10mers-PSCA
Each peptide is a portion of SEQ ID NO: 8;
each start position is specified, the
length of peptide is 10 amino acids, and
the end position for each peptide is the
start position plus nine.

| Pos | 1234567890 | score |
|---|---|---|
| 1 | RTPTRQISSS (SEQ ID NO: 5728) | 14 |

TABLE XXXVIII-continued

V25&V26-HLA-A26-10mers-PSCA
Each peptide is a portion of SEQ ID NO: 8;
each start position is specified, the
length of peptide is 10 amino acids, and
the end position for each peptide is the
start position plus nine.

| Pos | 1234567890 | score |
|---|---|---|
| 3 | PTRQISSSDT (SEQ ID NO: 5729) | 9 |

TABLE XXXVIII

V26-HLA-A26-10mers-PSCA
Each peptide is a portion of SEQ ID NO: 8;
each start position is specified, the
length of peptide is 10 amino acids, and
the end position for each peptide is the
start position plus nine.

| Pos | 1234567890 | score |
|---|---|---|
| 1 | RTPTRQIGSS (SEQ ID NO: 5730) | 14 |
| 3 | PTRQIGSSDT (SEQ ID NO: 5731) | 9 |

TABLE XXXVIII

V27-HLA-A26-10mers-PSCA
Each peptide is a portion of SEQ ID NO: 8;
each start position is specified, the
length of peptide is 10 amino acids, and
the end position for each peptide is the
start position plus nine.

| Pos | 1234567890 | score |
|---|---|---|
| 1 | PSRGQALRRA (SEQ ID NO: 5732) | 4 |
| 2 | SRGQALRRAQ (SEQ ID NO: 5733) | 2 |

TABLE XXXIX

V1-HLA-B0702-10mers-PSCA
Each peptide is a portion
of SEQ ID NO: 2; each
start position is specified,
the length of peptide is 10
amino acids, and the end
position for each peptide is
the start position plus nine.

| Pos | 1234567890 | score |
|---|---|---|
| 101 | QPAAAILALL (SEQ ID NO: 5734) | 23 |
| 108 | ALLPALGLLL (SEQ ID NO: 5735) | 15 |

TABLE XXXIX-continued

V1-HLA-B0702-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 100 | LQPAAAILAL (SEQ ID NO: 5736) | 14 |
| 104 | AAILALLPAL (SEQ ID NO: 5737) | 14 |
| 106 | ILALLPALGL (SEQ ID NO: 5738) | 14 |
| 6 | LALLMAGLAL (SEQ ID NO: 5739) | 13 |
| 12 | GLALQPGTAL (SEQ ID NO: 5740) | 13 |
| 49 | WTARIRAVGL (SEQ ID NO: 5741) | 13 |
| 50 | TARIRAVGLL (SEQ ID NO: 5742) | 13 |
| 110 | LPALGLLLWG (SEQ ID NO: 5743) | 13 |
| 4 | VLLALLMAGL (SEQ ID NO: 5744) | 12 |
| 13 | LALQPGTALL (SEQ ID NO: 5745) | 12 |
| 52 | RIRAVGLLTV (SEQ ID NO: 5746) | 12 |
| 82 | KNITCCDTDL (SEQ ID NO: 5747) | 12 |
| 91 | LCNASGAHAL (SEQ ID NO: 5748) | 12 |
| 103 | AAAILALLPA (SEQ ID NO: 5749) | 12 |
| 16 | QPGTALLCYS (SEQ ID NO: 5750) | 11 |
| 27 | KAQVSNEDCL (SEQ ID NO: 5751) | 11 |
| 35 | CLQVENCTQL (SEQ ID NO: 5752) | 11 |

TABLE XXXIX-continued

V1-HLA-B0702-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 94 | ASGAHALQPA (SEQ ID NO: 5753) | 11 |
| 97 | AHALQPAAAI (SEQ ID NO: 5754) | 11 |
| 98 | HALQPAAAIL (SEQ ID NO: 5755) | 11 |

TABLE XXXIX

V4-HLA-B0702-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 176 | SPAPSRGQAL (SEQ ID NO: 5756) | 23 |
| 85 | VPEAHPNASL (SEQ ID NO: 5757) | 22 |
| 102 | VPHPDPPMAL (SEQ ID NO: 5758) | 22 |
| 126 | PPADGPSNPL (SEQ ID NO: 5759) | 22 |
| 27 | MPCSRLPPSL (SEQ ID NO: 5760) | 21 |
| 100 | APVPHPDPPM (SEQ ID NO: 5761) | 21 |
| 107 | PPMALSRTPT (SEQ ID NO: 5762) | 21 |
| 57 | APLQPTLGVV (SEQ ID NO: 5763) | 19 |
| 66 | VPQASVPLLT (SEQ ID NO: 5764) | 19 |
| 76 | HPAQWEPVLV (SEQ ID NO: 5765) | 19 |

TABLE XXXIX-continued

V4-HLA-B0702-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 60 | QPTLGVVPQA (SEQ ID NO: 5766) | 18 |
| 89 | HPNASLTMYV (SEQ ID NO: 5767) | 18 |
| 130 | GPSNPLCCCF (SEQ ID NO: 5768) | 18 |
| 141 | GPAFSTLNPV (SEQ ID NO: 5769) | 18 |
| 48 | DPASYRLWGA (SEQ ID NO: 5770) | 17 |
| 25 | GPMPCSRLPP (SEQ ID NO: 5771) | 16 |
| 178 | APSRGQALRR (SEQ ID NO: 5772) | 16 |
| 33 | PPSLRCSLHS (SEQ ID NO: 5773) | 14 |
| 50 | ASYRLWGAPL (SEQ ID NO: 5774) | 14 |
| 64 | GVVPQASVPL (SEQ ID NO: 5775) | 14 |
| 104 | HPDPPMALSR (SEQ ID NO: 5776) | 14 |
| 22 | TPAGPMPCSR (SEQ ID NO: 5777) | 13 |
| 31 | RLPPSLRCSL (SEQ ID NO: 5778) | 13 |
| 54 | LWGAPLQPTL (SEQ ID NO: 5779) | 13 |
| 75 | THPAQWEPVL (SEQ ID NO: 5780) | 13 |
| 138 | CFHGPAFSTL (SEQ ID NO: 5781) | 13 |
| 159 | AFPAHPIYDL (SEQ ID NO: 5782) | 13 |
| 23 | PAGPMPCSRL (SEQ ID NO: 5783) | 12 |
| 65 | VVPQASVPLL (SEQ ID NO: 5784) | 12 |
| 81 | EPVLVPEAHP (SEQ ID NO: 5785) | 12 |
| 142 | PAFSTLNPVL (SEQ ID NO: 5786) | 12 |
| 8 | WARRTSRAVT (SEQ ID NO: 5787) | 11 |
| 15 | AVTPTCATPA (SEQ ID NO: 5788) | 11 |
| 17 | TPTCATPAGP (SEQ ID NO: 5789) | 11 |
| 45 | CSGDPASYRL (SEQ ID NO: 5790) | 11 |
| 69 | ASVPLLTHPA (SEQ ID NO: 5791) | 11 |
| 71 | VPLLTHPAQW (SEQ ID NO: 5792) | 11 |
| 110 | ALSRTPTRQI (SEQ ID NO: 5793) | 11 |
| 119 | IGSIDTDPPA (SEQ ID NO: 5794) | 11 |
| 125 | DPPADGPSNP (SEQ ID NO: 5795) | 11 |
| 133 | NPLCCCFHGP (SEQ ID NO: 5796) | 11 |
| 148 | NPVLRHLFPQ (SEQ ID NO: 5797) | 11 |
| 155 | FPQEAFPAHP (SEQ ID NO: 5798) | 11 |
| 160 | FPAHPIYDLS (SEQ ID NO: 5799) | 11 |

TABLE XXXIX-continued

V4-HLA-B0702-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 163 | HPIYDLSQVW (SEQ ID NO: 5800) | 11 |

TABLE XXXIX

V19-HLA-B0702-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 4 | MPCSRLLPSL (SEQ ID NO: 5801) | 21 |
| 2 | GPMPCSRLLP (SEQ ID NO: 5802) | 15 |
| 10 | LPSLRCSLHS (SEQ ID NO: 5803) | 14 |
| 8 | RLLPSLRCSL (SEQ ID NO: 5804) | 13 |
| 1 | AGPMPCSRLL (SEQ ID NO: 5805) | 12 |

TABLE XXXIX

V20-HLA-B0702-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 6 | DPASSRLWGA (SEQ ID NO: 5806) | 17 |
| 8 | ASSRLWGAPL (SEQ ID NO: 5807) | 16 |
| 3 | CSGDPASSRL (SEQ ID NO: 5808) | 11 |

TABLE XXXIX

V21-HLA-B0702-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 10 | DPAQWEPVLV (SEQ ID NO: 5809) | 19 |
| 9 | TDPAQWEPVL (SEQ ID NO: 5810) | 13 |
| 3 | ASVPLLTDPA (SEQ ID NO: 5811) | 11 |
| 5 | VPLLTDPAQW (SEQ ID NO: 5812) | 11 |
| 8 | LTDPAQWEPV (SEQ ID NO: 5813) | 9 |

TABLE XXXIX

V21&22-HLA-B0702-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 1 | QASVPLLTDL (SEQ ID NO: 5814) | 13 |
| 8 | TDLAQWEPVL (SEQ ID NO: 5815) | 13 |
| 4 | VPLLTDLAQW (SEQ ID NO: 5816) | 11 |
| 2 | ASVPLLTDLA (SEQ ID NO: 5817) | 10 |
| 9 | DLAQWEPVLV (SEQ ID NO: 5818) | 9 |
| 7 | LTDLAQWEPV (SEQ ID NO: 5819) | 8 |

TABLE XXXIX

V22-HLA-B0702-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 1 | QASVPLLTHL (SEQ ID NO: 5820) | 13 |
| 8 | THLAQWEPVL (SEQ ID NO: 5821) | 13 |
| 4 | VPLLTHLAQW (SEQ ID NO: 5822) | 11 |
| 2 | ASVPLLTHLA (SEQ ID NO: 5823) | 10 |
| 9 | HLAQWEPVLV (SEQ ID NO: 5824) | 9 |

TABLE XXXIX

V24-HLA-B0702-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 10 | TPVPHPDPPM (SEQ ID NO: 5825) | 19 |
| 1 | NASLTMYVCT (SEQ ID NO: 5826) | 10 |

TABLE XXXIX

V25-HLA-B0702-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 9 | ISSIDTDPPA (SEQ ID NO: 5827) | 11 |
| 4 | TPTRQISSID (SEQ ID NO: 5828) | 10 |
| 5 | PTRQISSIDT (SEQ ID NO: 5829) | 8 |
| 3 | RTPTRQISSI (SEQ ID NO: 5830) | 7 |

TABLE XXXIX

V25&26-HLA-B0702-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 7 | ISSSDTDPPA (SEQ ID NO: 5831) | 11 |
| 2 | TPTRQISSSD (SEQ ID NO: 5832) | 10 |
| 3 | PTRQISSSDT (SEQ ID NO: 5833) | 8 |

TABLE XXXIX

V26-HLA-B0702-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 7 | IGSSDTDPPA (SEQ ID NO: 5834) | 11 |
| 2 | TPTRQIGSS (SEQ ID NO: 5835) | 10 |
| 3 | PTRQIGSSDT (SEQ ID NO: 5836) | 8 |

TABLE XXXIX

V27-HLA-B0702-10mers-PSCA Each peptide is a portion of SEQ ID NO: 8; each start position is specified, the length of peptide is 10 amino acids, and the end position for each peptide is the start position plus nine.

| Pos | 1234567890 | score |
|---|---|---|
| 1 | PSRGQALRRA (SEQ ID NO: 5837) | 10 |

TABLE XL

V1-HLA-B08-10mers-PSCA

| Pos | 1234567890 | score |
|---|---|---|
| NoResultsFound. | | |

TABLE XL

V4-HLA-B08-10mers-PSCA

| Pos | 1234567890 | score |
|---|---|---|
| NoResultsFound. | | |

TABLE XL

V19-HLA-B08-10mers-PSCA

| Pos | 1234567890 | score |
|---|---|---|
| NoResultsFound. | | |

TABLE XL

V20-HLA-B08-10mers-PSCA

| Pos | 1234567890 | score |
|---|---|---|
| NoResultsFound. | | |

TABLE XL

V21-HLA-B08-10mers-PSCA

| Pos | 1234567890 | score |
|---|---|---|
| NoResultsFound. | | |

TABLE XL

V21&22-HLA-B08-10mers-PSCA

| Pos | 1234567890 | score |
|---|---|---|
| NoResultsFound. | | |

TABLE XL

V22HLA-B08-10mers-PSCA

| Pos | 1234567890 | score |
|---|---|---|
| NoResultsFound. | | |

TABLE XL

V24-HLA-B08-10mers-PSCA

| Pos | 1234567890 | score |
|---|---|---|
| NoResultsFound. | | |

TABLE XL

V25-HLA-B08-10mers-PSCA

| Pos | 1234567890 | score |
|---|---|---|
| NoResultsFound. | | |

TABLE XL

V25&26-HLA-B08-10mers-PSCA

| Pos | 1234567890 | score |
|---|---|---|
| NoResultsFound. | | |

TABLE XL

V26-HLA-B08-10mers-PSCA

| Pos | 1234567890 | score |
|---|---|---|
| NoResultsFound. | | |

TABLE XLI

V1-HLA-B1510-10mers-PSCA

| Pos | 1234567890 | score |
|---|---|---|
| NoResultsFound. | | |

TABLE XLI

V4-HLA-B1510-10mers-PSCA

| Pos | 1234567890 | score |
|---|---|---|
| NoResultsFound. | | |

TABLE XLI

V19-HLA-B1510-10mers-PSCA

| Pos | 1234567890 | score |
|---|---|---|
| No Results Found. | | |

TABLE XLI

V20-HLA-B1510-10mers-PSCA

| Pos | 1234567890 | score |
|---|---|---|
| No Results Found. | | |

TABLE XLI

V21-HLA-B1510-10mers-PSCA

| Pos | 1234567890 | score |
|---|---|---|
| No Results Found. | | |

TABLE XLI

V21&22-HLA-B1510-10mers-PSCA

| Pos | 1234567890 | score |
|---|---|---|
| No Results Found. | | |

TABLE XLI

V22-HLA-1B1510-10mers-PSCA

| Pos | 1234567890 | score |
|---|---|---|
| No Results Found. | | |

TABLE XLI

V24-HLA-1B1510-10mers-PSCA

| Pos | 1234567890 | score |
|---|---|---|
| No Results Found. | | |

TABLE XLI

V25-HLA-1B1510-10mers-PSCA

| Pos | 1234567890 | score |
|---|---|---|
| No Results Found. | | |

TABLE XLI

V25&26-HLA-B1510-10mers-PSCA

| Pos | 1234567890 | score |
|---|---|---|
| No Results Found. | | |

TABLE XLI

V26-HLA-B1510-10mers-PSCA

| Pos | 1234567890 | score |
|---|---|---|
| No Results Found. | | |

TABLE XLII

V1-HLA-B2705-10mers-PSCA

| Pos | 1234567890 | score |
|---|---|---|
| No Results Found. | | |

TABLE XLII

V4-HLA-B2705-10mers-PSCA

| Pos | 1234567890 | score |
|---|---|---|
| No Results Found. | | |

TABLE XLII

V19-HLA-B2705-10mers-PSCA

| Pos | 1234567890 | score |
|---|---|---|
| No Results Found. | | |

TABLE XLII

V20-HLA-B2705-10mers-PSCA

| Pos | 1234567890 | score |
|---|---|---|
| No Results Found. | | |

TABLE XLII

V21-HLA-B2705-10mers-PSCA

| Pos | 1234567890 | score |
|---|---|---|
| No Results Found. | | |

TABLE XLII

V21&22-HLA-B2705-10mers-PSCA

| Pos | 1234567890 | score |
|---|---|---|
| NoResultsFound. | | |

TABLE XLII

V22-HLA-B2705-10mers-PSCA

| Pos | 1234567890 | score |
|---|---|---|
| NoResultsFound. | | |

TABLE XLII

V24-HLA-B2705-10mers-PSCA

| Pos | 1234567890 | score |
|---|---|---|
| NoResultsFound. | | |

TABLE XLII

V25-HLA-B2705-10mers-PSCA

| Pos | 1234567890 | score |
|---|---|---|
| NoResultsFound. | | |

TABLE XLII

V25&26-HLA-B2705-10mers-PSCA

| Pos | 1234567890 | score |
|---|---|---|
| NoResultsFound. | | |

TABLE XLII

V26-HLA-B2705-10mers-PSCA

| Pos | 1234567890 | score |
|---|---|---|
| NoResultsFound. | | |

TABLE XLIII

V1-HLA-B2709-10mers-PSCA

| Pos | 1234567890 | score |
|---|---|---|
| NoResultsFound. | | |

TABLE XLIII

V4-HLA-B2709-10mers-PSCA

| Pos | 1234567890 | score |
|---|---|---|
| NoResultsFound. | | |

TABLE XLIII

V19-HLA-B2709-10mers-PSCA

| Pos | 1234567890 | score |
|---|---|---|
| NoResultsFound. | | |

TABLE XLIII

V20-HLA-B2709-10mers-PSCA

| Pos | 1234567890 | score |
|---|---|---|
| NoResultsFound. | | |

TABLE XLIII

V21-HLA-B2709-10mers-PSCA

| Pos | 1234567890 | score |
|---|---|---|
| NoResultsFound. | | |

TABLE XLIII

V21&22-HLA-B2709-10mers-PSCA

| Pos | 1234567890 | score |
|---|---|---|
| NoResultsFound. | | |

TABLE XLIII

V22-HLA-B2709-10mers-PSCA

| Pos | 1234567890 | score |
|---|---|---|
| NoResultsFound. | | |

TABLE XLIII

V24-HLA-B2709-10mers-PSCA

| Pos | 1234567890 | score |
|---|---|---|
| NoResultsFound. | | |

TABLE XLIII

V25-HLA-B2709-10mers-PSCA

| Pos | 1234567890 | score |
|---|---|---|
| NoResultsFound. | | |

TABLE XLIII

V25&26-HLA-B2709-10mers-PSCA

| Pos | 1234567890 | score |
|---|---|---|
| NoResultsFound. | | |

TABLE XLIII

V26-HLA-B2709-10mers-PSCA

| Pos | 1234567890 | score |
|---|---|---|
| NoResultsFound. | | |

TABLE XLIV

V1-HLA-B4402-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 104 | AAILALLPAL (SEQ ID NO: 5838) | 20 |
| 108 | ALLPALGLLL (SEQ ID NO: 5839) | 19 |
| 100 | LQPAAAILAL (SEQ ID NO: 5840) | 17 |
| 6 | LALLMAGLAL (SEQ ID NO: 5841) | 15 |
| 82 | KNITCCDTDL (SEQ ID NO: 5842) | 15 |
| 97 | AHALQPAAAI (SEQ ID NO: 5843) | 15 |
| 15 | LQPGTALLCY (SEQ ID NO: 5844) | 14 |
| 91 | LCNASGAHAL (SEQ ID NO: 5845) | 14 |

TABLE XLIV-continued

V1-HLA-B4402-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 107 | LALLPALGLL (SEQ ID NO: 5846) | 14 |
| 109 | LLPALGLLLW (SEQ ID NO: 5847) | 14 |
| 114 | GLLLWGPGQL (SEQ ID NO: 5848) | 14 |
| 12 | GLALQPGTAQ (SEQ ID NO: 5849) | 13 |
| 13 | LALQPGTALL (SEQ ID NO: 5850) | 13 |
| 32 | NEDCLQVENC (SEQ ID NO: 5851) | 13 |
| 49 | WTARIRAVGL (SEQ ID NO: 5852) | 13 |
| 106 | ILALLPALGL (SEQ ID NO: 5853) | 13 |
| 45 | GEQCWTARIR (SEQ ID NO: 5854) | 12 |
| 50 | TARIRAVGLL (SEQ ID NO: 5855) | 12 |
| 69 | NCVDDSQDYY (SEQ ID NO: 5856) | 12 |
| 98 | HALQPAAAIL (SEQ ID NO: 5857) | 12 |
| 101 | QPAAAILALL (SEQ ID NO: 5858) | 12 |
| 4 | VLLALLMAGL (SEQ ID NO: 5859) | 11 |
| 27 | KAQVSNEDCL (SEQ ID NO: 5860) | 11 |
| 35 | CLQVENCTQL (SEQ ID NO: 5861) | 11 |
| 38 | VENCTQLGEQ (SEQ ID NO: 5862) | 11 |

TABLE XLIV-continued

V1-HLA-B4402-10mers-PSCA
Each peptide is a portion of SEQ ID NO: 2; each start position is specified, the length of peptide is 10 amino acids, and the end position for each peptide is the start position plus nine.

| Pos | 1234567890 | score |
|---|---|---|
| 40 | NCTQLGEQCW (SEQ ID NO: 5863) | 11 |
| 53 | IRAVGLLTVI (SEQ ID NO: 5864) | 10 |
| 59 | LTVISKGCSL (SEQ ID NO: 5865) | 10 |
| 68 | LNCVDDSQDY (SEQ ID NO: 5866) | 10 |
| 75 | QDYYVGKKNI (SEQ ID NO: 5867) | 10 |
| 14 | ALQPGTALLC (SEQ ID NO: 5868) | 9 |
| 44 | LGEQCWTARI (SEQ ID NO: 5869) | 9 |
| 51 | ARIRAVGLLT (SEQ ID NO: 5870) | 9 |
| 99 | ALQPAAAILA (SEQ ID NO: 5871) | 9 |

TABLE XLIV

V4-HLA-B4402-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 157 | QEAFPAHPIY (SEQ ID NO: 5872) | 20 |
| 46 | SGDPASYRLW (SEQ ID NO: 5873) | 17 |
| 159 | AFPAHPIYDL (SEQ ID NO: 5874) | 17 |
| 88 | AHPNASLTMY (SEQ ID NO: 5875) | 16 |

TABLE XLIV-continued

V4-HLA-B4402-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 102 | VPHPDPPMAL (SEQ ID NO: 5876) | 16 |
| 110 | ALSRTPTRQI (SEQ ID NO: 5877) | 16 |
| 146 | TLNPVLRHLF (SEQ ID NO: 5878) | 16 |
| 176 | SPAPSRGQAL (SEQ ID NO: 5879) | 16 |
| 31 | RLPPSLRCSL (SEQ ID NO: 5880) | 15 |
| 145 | STLNPVLRHL (SEQ ID NO: 5881) | 15 |
| 43 | ACCSGDPASY (SEQ ID NO: 5882) | 14 |
| 50 | ASYRLWGAPL (SEQ ID NO: 5883) | 14 |
| 64 | GVVPQASVPL (SEQ ID NO: 5884) | 14 |
| 71 | VPLLTHPAQW (SEQ ID NO: 5885) | 14 |
| 80 | WEPVLVPEAH (SEQ ID NO: 5886) | 14 |
| 163 | HPIYDLSQVW (SEQ ID NO: 5887) | 14 |
| 23 | PAGPMPCSRL (SEQ ID NO: 5888) | 13 |
| 65 | VVPQASVPLL (SEQ ID NO: 5889) | 13 |
| 113 | RTPTRQIGSI (SEQ ID NO: 5890) | 13 |
| 138 | CFHGPAFSTL (SEQ ID NO: 5891) | 13 |
| 142 | PAFSTLNPVL (SEQ ID NO: 5892) | 13 |

TABLE XLIV-continued

V4-HLA-B4402-10mers-PSCA
Each peptide is a portion of
SEQ ID NO: 8; each start
position is specified, the
length of peptide is 10
amino acids, and the end
position for each peptide is
the start position plus nine.

| Pos | 1234567890 | score |
|-----|------------|-------|
| 151 | LRHLFPQEAF (SEQ ID NO: 5893) | 13 |
| 75 | THPAQWEPVL (SEQ ID NO: 5894) | 12 |
| 86 | PEAHPNASLT (SEQ ID NO: 5895) | 12 |
| 126 | PPADGPSNPL (SEQ ID NO: 5896) | 12 |
| 130 | GPSNPLCCCF (SEQ ID NO: 5897) | 12 |
| 135 | LCCCFHGPAF (SEQ ID NO: 5898) | 12 |
| 27 | MPCSRLPPSL (SEQ ID NO: 5899) | 11 |
| 45 | CSGDPASYRL (SEQ ID NO: 5900) | 11 |
| 54 | LWGAPLQPTL (SEQ ID NO: 5901) | 11 |
| 85 | VPEAHPNASL (SEQ ID NO: 5902) | 10 |
| 156 | PQEAFPAHPI (SEQ ID NO: 5903) | 10 |
| 158 | EAFPAHPIYD (SEQ ID NO: 5904) | 9 |

TABLE XLIV

V19-HLA-B4402-10mers-PSCA
Each peptide is a portion
of SEQ ID NO: 8; each
start position is specified,
the length of peptide is 10
amino acids, and the end
position for each peptide is
the start position plus nine.

| Pos | 1234567890 | score |
|-----|------------|-------|
| 1 | AGPMPCSRLL (SEQ ID NO: 5905) | 16 |

TABLE XLIV-continued

V19-HLA-B4402-10mers-PSCA
Each peptide is a portion
of SEQ ID NO: 8; each
start position is specified,
the length of peptide is 10
amino acids, and the end
position for each peptide is
the start position plus nine.

| Pos | 1234567890 | score |
|-----|------------|-------|
| 8 | RLLPSLRCSL (SEQ ID NO: 5906) | 15 |
| 4 | MPCSRLLPSL (SEQ ID NO: 5907) | 11 |
| 2 | GPMPCSRLLP (SEQ ID NO: 5908) | 7 |

TABLE XLIV

V20-HLA-B4402-10mers-PSCA
Each peptide is a portion of
SEQ ID NO: 8; each start
position is specified, the
length of peptide is 10
amino acids, and the end
position for each peptide is
the start position plus nine.

| Pos | 1234567890 | score |
|-----|------------|-------|
| 4 | SGDPASSRLW (SEQ ID NO: 5909) | 17 |
| 8 | ASSRLWGAPL (SEQ ID NO: 5910) | 15 |
| 3 | CSGDPASSRL (SEQ ID NO: 5911) | 11 |

TABLE XLIV

V21-HLA-B4402-10mers-PSCA
Each peptide is a portion
of SEQ ID NO: 8; each
start posidon is specified,
the length of pepUde is 10
amino acids, and the end
position for each pepdde is
the start position plus nine.

| Pos | 1234567890 | score |
|-----|------------|-------|
| 5 | VPLLTDPAQW (SEQ ID NO: 5912) | 14 |
| 9 | TDPAQWEPVL (SEQ ID NO: 5913) | 12 |
| 3 | ASVPLLTDPA (SEQ ID NO: 5914) | 7 |

TABLE XLIV

V21&22-HLA-B4402-10mers-PSCA
Each peptide is a portion
of SEQ ID NO: 8; each
start position is specified,
the length of peptide is 10
amino acids, and the end
position for each peptide is
the start position plus nine.

| Pos | 1234567890 | score |
|---|---|---|
| 4 | VPLLTDLAQW (SEQ ID NO: 5915) | 14 |
| 1 | QASVPLLTDL (SEQ ID NO: 5916) | 12 |
| 8 | TDLAQWEPVL (SEQ ID NO: 5917) | 12 |
| 2 | ASVPLLTDLA (SEQ ID NO: 5918) | 8 |
| 3 | SVPLLTDLAQ (SEQ ID NO: 5919) | 6 |

TABLE XLIV

V22-HLA-B4402-10mers-PSCA
Each peptide is a portion
of SEQ ID NO: 8; each
start position is specified,
the lenght of peptide is 10
amino acids, and the end
position for each peptide is
the start position plus nine.

| Pos | 1234567890 | score |
|---|---|---|
| 4 | VPLLTHLAQW (SEQ ID NO: 5920) | 14 |
| 1 | QASVPLLTHL (SEQ ID NO: 5921) | 12 |
| 8 | THLAQWEPVL (SEQ ID NO: 5922) | 12 |
| 2 | ASVPLLTHLA (SEQ ID NO: 5923) | 9 |
| 3 | SVPLLTHLAQ (SEQ ID NO: 5924) | 6 |

TABLE XLIV

V24-HLA-B4402-10mers-PSCA
Each peptide is a portion
of SEQ ID NO: 8; each
start position is specified,
the length of peptide is 10
amino acids, and the end
position for each peptide is
the start position plus nine.

| Pos | 1234567890 | score |
|---|---|---|
| 2 | ASLTMYVCTP (SEQ ID NO: 5925) | 7 |
| 1 | NASLTMYVCT (SEQ ID NO: 5926) | 4 |
| 4 | LTMYVCTPVP (SEQ ID NO: 5927) | 3 |
| 7 | YVCTPVPHPD (SEQ ID NO: 5928) | 3 |
| 8 | VCTPVPHPDP (SEQ ID NO: 5929) | 3 |
| 10 | TPVPHPDPPM (SEQ ID NO: 5930) | 3 |

TABLE XLIV

V25-HLA-B4402-10mers-PSCA
Each peptide is a portion
of SEQ ID NO: 8; each
start position is specified,
the length of peptide is 10
amino acids, and the end
position for each peptide
is the start posidon plus
nine.

| Pos | 1234567890 | score |
|---|---|---|
| 3 | RTPTRQISSI (SEQ ID NO: 5931) | 13 |
| 10 | SSIDTDPPAD (SEQ ID NO: 5932) | 8 |

TABLE XLIV

V25&26-HLA-B4402-10mers-PSCA
Each peptide is a portion
of SEQ ID NO: 8; each
start position is specified,
the length of peptide is 10
amino acids, and the end
position for each peptide is
the start position plus nine.

| Pos | 1234567890 | score |
|---|---|---|
| 8 | SSSDTDPPAD (SEQ ID NO: 5933) | 6 |

TABLE XLIV-continued

V25&26-HLA-B4402-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 1 | RTPTRQISSS (SEQ ID NO: 5934) | 5 |
| 5 | RQISSSDTDP (SEQ ID NO: 5935) | 3 |
| 6 | QISSSDTDPP (SEQ ID NO: 5936) | 2 |

TABLE XLIV

V26-HLA-B4402-10mers-PSCA
Each peptide is a portion of SEQ ID NO: 8; each start posidon is specified, the length of pepflde is 10 amino acids, and the end posifion for each peptide is the start position plus nine.

| Pos | 1234567890 | score |
|---|---|---|
| 1 | RTPTRQIGSS (SEQ ID NO: 5937) | 5 |
| 8 | GSSDTDPPAD (SEQ ID NO: 5938) | 5 |
| 5 | RQIGSSDTDP (SEQ ID NO: 5939) | 4 |
| 9 | SSDTDPPADG (SEQ ID NO: 5940) | 4 |
| 10 | SDTDPPADGP (SEQ ID NO: 5941) | 3 |

TABLE XLIV

V27-HLA-B4402-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 2 | SRGQALRRAQ (SEQ ID NO: 5942) | 5 |

TABLE XLIV-continued

V27-HLA-B4402-10mers-PSCA
Each peptide is a portion of SEQ ID NO: 8; each start position is specified, the length of peptide is 10 amino acids, and the end position for each peptide is the start position plus nine.

| Pos | 1234567890 | score |
|---|---|---|
| 1 | PSRGQALRRA (SEQ ID NO: 5943) | 3 |

TABLE XLV

V1-HLA-B5101-10mers-PSCA

| Pos | 1234567890 | score |
|---|---|---|
| NoResultsFound. | | |

TABLE XLV

V4-HLA-B5101-10mers-PSCA

| Pos | 1234567890 | score |
|---|---|---|
| NoResultsFound. | | |

TABLE XLV

V19-HLA-B5101-10mers-PSCA

| Pos | 1234567890 | score |
|---|---|---|
| NoResultsFound. | | |

TABLE XLV

V20-HLA-B4402-10mers-PSCA

| Pos | 1234567890 | score |
|---|---|---|
| NoResultsFound. | | |

TABLE XLV

V21-HLA-B5101-10mers-PSCA

| Pos | 1234567890 | score |
|---|---|---|
| NoResultsFound. | | |

TABLE XLV

V21&22-HLA-B5101-10mers PSCA

| Pos | 1234567890 | score |
|---|---|---|
| NoResultsFound. | | |

TABLE XLV

V22-HLA-B5101-10mers-PSCA

| Pos | 1234567890 | score |
|---|---|---|
| NoResultsFound. | | |

TABLE XLV

V24-HLA-B5101-10mers-PSCA

| Pos | 1234567890 | score |
|---|---|---|
| NoResultsFound. | | |

TABLE XLV

V25-HLA-B5101-10mers-PSCA

| Pos | 1234567890 | score |
|---|---|---|
| NoResultsFound. | | |

TABLE XLV

V25/26-HLA-B5101-10mers-PSCA

| Pos | 1234567890 | score |
|---|---|---|
| NoResultsFound. | | |

TABLE XLV

V26-HLA-B5101-10mers-PSCA

| Pos | 1234567890 | score |
|---|---|---|
| NoResultsFound. | | |

TABLE XLVI

V1-HLA-DRB1-0101-15mers-PSCA
Each peptide is a portion of SEQ ID NO: 2; each start position is specified, the length of peptide is 15 amino acids, and the end position for each peptide is the start position plus fourteen.

| Pos | 123456789012345 | score |
|---|---|---|
| 104 | AAILALLPALGLLLW (SEQ ID NO: 5944) | 35 |
| 3 | AVLLALLMAGLALQP (SEQ ID NO: 5945) | 33 |
| 10 | MAGLALQPGTALLCY (SEQ ID NO: 5946) | 32 |
| 2 | KAVLLALLMAGLALQ (SEQ ID NO: 5947) | 26 |
| 50 | TARIRAVGLLTVISK (SEQ ID NO: 5948) | 25 |
| 6 | LALLMAGLALQPGTA (SEQ ID NO: 5949) | 24 |
| 47 | QCWTARIRAVGLLTV (SEQ ID NO: 5950) | 24 |
| 88 | DTDLCNASGAHALQP (SEQ ID NO: 5951) | 24 |
| 97 | AHALQPAAAILALLP (SEQ ID NO: 5952) | 24 |
| 106 | ILALLPALGLLLWGP (SEQ ID NO: 5953) | 24 |
| 4 | VLLALLMAGLALQPG (SEQ ID NO: 5954) | 23 |
| 52 | RIRAVGLLTVISKGC (SEQ ID NO: 5955) | 23 |
| 55 | AVGLLTVISKGCSLN (SEQ ID NO: 5956) | 23 |
| 56 | VGLLTVISKGCSLNC (SEQ ID NO: 5957) | 23 |
| 95 | SGAHALQPAAAILAL (SEQ ID NO: 5958) | 23 |
| 9 | LMAGLALQPGTALLC (SEQ ID NO: 5959) | 22 |
| 94 | ASGAHALQPAAAILA (SEQ ID NO: 5960) | 22 |

TABLE XLVI-continued

V1-HLA-DRB1-0101-15mers-PSCA
Each peptide is a portion of SEQ ID NO: 2; each start position is specified, the length of peptide is 15 amino acids, and the end position for each peptide is the start position plus fourteen.

| Pos | 123456789012345 | score |
|---|---|---|
| 100 | SQPAAAILALLPALG (SEQ ID NO: 5961) | 22 |
| 103 | AAAILALLPALGLLL (SEQ ID NO: 5962) | 22 |
| 57 | GLLTVISKGCSLNCV (SEQ ID NO: 5963) | 20 |
| 86 | CCDTDLCNASGAHAL (SEQ ID NO: 5964) | 19 |
| 101 | QPAAAILALLPALGL (SEQ ID NO: 5965) | 19 |
| 89 | TDLCNASGAHALQPA (SEQ ID NO: 5966) | 18 |
| 109 | LLPALGLLLWGPGQL (SEQ ID NO: 5967) | 18 |
| 33 | EDCLQVENCTQLGEQ (SEQ ID NO: 5968) | 17 |
| 53 | IRAVGLLTVISKGCS (SEQ ID NO: 5969) | 17 |
| 107 | LALLPALGLLLWGPG (SEQ ID NO: 5970) | 17 |

TABLE XLVI

V4-HLA-DRB1-0101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 148 | NPVLRHLFPQEAFPA (SEQ ID NO: 5971) | 32 |
| 151 | LRHLFPQEAFPAHPI (SEQ ID NO: 5972) | 31 |
| 169 | SQVWSbbSPAPSRGQ (SEQ ID NO: 5973) | 30 |

TABLE XLVI-continued

V4-HLA-DRB1-0101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 62 | TLGVVPQASVPLLTH (SEQ ID NO: 5974) | 29 |
| 116 | TRQIGSIDTDPPADG (SEQ ID NO: 5975) | 28 |
| 165 | IYDLSQVWSVVSPAP (SEQ ID NO: 5976) | 28 |
| 168 | LSQVWSVVSPAPSRG (SEQ ID NO: 5977) | 28 |
| 13 | SRAVTPTCATPAGPM (SEQ ID NO: 5978) | 26 |
| 5 | TTTWARRTSRAVTPT (SEQ ID NO: 5979) | 25 |
| 48 | DPASYRLWGAPLQPT (SEQ ID NO: 5980) | 24 |
| 56 | GAPLQPTLGVVPQAS (SEQ ID NO: 5981) | 24 |
| 77 | PAQWEPVLVPEAHPN (SEQ ID NO: 5982) | 24 |
| 141 | GPAFSTLNPVLRHLF (SEQ ID NO: 5983) | 24 |
| 162 | AHPIYDLSQVWSVVS (SEQ ID NO: 5984) | 24 |
| 10 | RRTSRAVTPTCATPA (SEQ ID NO: 5985) | 23 |
| 54 | LWGAPLQPTLGVVPQ (SEQ ID NO: 5986) | 23 |
| 67 | PQASVPLLTHPAQWE (SEQ ID NO: 5987) | 23 |
| 108 | PMALSRTPTRQIGSI (SEQ ID NO: 5988) | 23 |
| 144 | FSTLNPVLRHLFPQE (SEQ ID NO: 5989) | 23 |
| 49 | PASYRLWGAPLQPTL (SEQ ID NO: 5990) | 22 |

TABLE XLVI-continued

V4-HLA-DRB1-0101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 60 | QPTLGVVPQASVPLL (SEQ ID NO: 5991) | 22 |
| 82 | PVLVPEAHPNASLTM (SEQ ID NO: 5992) | 22 |
| 92 | ASLTMYVCAPVPHPD (SEQ ID NO: 5993) | 22 |
| 99 | CAPVPHPDPPMALSR (SEQ ID NO: 5994) | 22 |
| 59 | LQPTLGVVPQASVPQ (SEQ ID NO: 5995) | 20 |
| 94 | LTMYVOAPVPHPDPP (SEQ ID NO: 5996) | 19 |
| 120 | GSIDTDPPADGPSNP (SEQ ID NO: 5997) | 19 |
| 163 | HPIYDLSQVWSVVSP (SEQ ID NO: 5998) | 19 |
| 7 | TWARRTSRAVTPTCA (SEQ ID NO: 5999) | 18 |
| 52 | YRLWGAPLQPTLGVV (SEQ ID NO: 6000) | 18 |
| 91 | NASLTMYVCAPVPHP (SEQ ID NO: 6001) | 18 |
| 136 | CCCFHGPAFSTLNPV (SEQ ID NO: 6002) | 18 |
| 157 | QEAFPAHPIYDLSQV (SEQ ID NO: 6003) | 18 |
| 15 | AVTPTCATPAGPMPC (SEQ ID NO: 6004) | 17 |
| 35 | SLRCSLHSACCSGDP (SEQ ID NO: 6005) | 17 |
| 61 | PTLGVVPQASVPLLT (SEQ ID NO: 6006) | 17 |
| 68 | QASVPLLTHPAQWEP (SEQ ID NO: 6007) | 17 |
| 71 | VPLLTHPAQWEPVLV (SEQ ID NO: 6008) | 17 |
| 80 | WEPVLVPEAHPNASL (SEQ ID NO: 6009) | 17 |
| 81 | EPVLVPEAHPNASLT (SEQ ID NO: 6010) | 17 |
| 172 | WSVVSPAPSRGQALR (SEQ ID NO: 6011) | 17 |
| 16 | VTPTCATPAGPMPCS (SEQ ID NO: 6012) | 16 |
| 17 | TPTCATPAGPMPCSR (SEQ ID NO: 6013) | 16 |
| 22 | TPAGPMPCSRLPPSL (SEQ ID NO: 6014) | 16 |
| 24 | AGPMPCSRLPPSLRC (SEQ ID NO: 6015) | 16 |
| 29 | CSRLPPSLRCSLHSA (SEQ ID NO: 6016) | 16 |
| 39 | SLHSACCSGDPASYR (SEQ ID NO: 6017) | 16 |
| 63 | LGVVPQASVPLLTHP (SEQ ID NO: 6018) | 16 |
| 70 | SVPLLTHPAQWEPVL (SEQ ID NO: 6019) | 16 |
| 79 | QWEPVLVPEAHPNAS (SEQ ID NO: 6020) | 16 |
| 104 | HPDPPMALSRTPTRQ (SEQ ID NO: 6021) | 16 |
| 132 | SNPLCCCFHGPAFST (SEQ ID NO: 6022) | 16 |
| 133 | NPLCCCFHGPAFSTL (SEQ ID NO: 6023) | 16 |
| 134 | PLCCCFHGPAFSTLN (SEQ ID NO: 6024) | 16 |

TABLE XLVI-continued

V4-HLA-DRB1-0101-15mers-PSCA
Each peptide is a portion of SEQ ID
NO: 8; each start position is
specified, the length of peptide is
15 amino acids, and the end
position for each peptide is the start
position plus fourteen.

| Pos | 123456789012345 | score |
|---|---|---|
| 145 | STLNPVLRHLFPQEA (SEQ ID NO: 6025) | 16 |
| 154 | LFPQEAFPAHPIYDL (SEQ ID NO: 6026) | 16 |
| 174 | VVSPAPSRGQALRRA (SEQ ID NO: 6027) | 16 |
| 31 | RLPPSLRCSLHSACC (SEQ ID NO: 6028) | 16 |
| 53 | RLWGAPLQPTLGVVP (SEQ ID NO: 6029) | 15 |
| 74 | LTHPAQWEPVLVPEA (SEQ ID NO: 6030) | 15 |
| 87 | EAHPNASLTMYVDAP (SEQ ID NO: 6031) | 15 |
| 106 | DPPMALSRTPTRQIG (SEQ ID NO: 6032) | 15 |
| 112 | SRTPTRQIGSIDTDP (SEQ ID NO: 6033) | 15 |
| 113 | RTPTRQIGSIDTDPP (SEQ ID NO: 6034) | 15 |
| 123 | DTDPPADGPSNPLCC (SEQ ID NO: 6035) | 15 |
| 171 | VWSVVSPAPSRGQAL (SEQ ID NO: 6036) | 15 |

TABLE XLVI

V19-HLA-DRB1-0101-15mers-PSCA
Each peptide is a portion of SEQ ID
NO: 8; each start position is
specified, the length of peptide is
15 amino acids, and the end
position for each peptide is the start
position plus fourteen.

| Pos | 123456789012345 | score |
|---|---|---|
| 9 | MPCSRLLPSLRCSLH (SEQ ID NO: 6037) | 17 |
| 4 | TPAGPMPCSRLLPSL (SEQ ID NO: 6038) | 16 |
| 6 | AGPMPCSRLLPSLRC (SEQ ID NO: 6039) | 16 |
| 11 | CSRLLPSLRCSLHSA (SEQ ID NO: 6040) | 16 |
| 12 | SRLLPSLRCSLHSAC (SEQ ID NO: 6041) | 16 |
| 13 | RLLPSLRCSLHSACC (SEQ ID NO: 6042) | 15 |
| 3 | ATPAGPMPCSRLLPS (SEQ ID NO: 6043) | 14 |
| 8 | PMPCSRLLPSLRCSL (SEQ ID NO: 6044) | 14 |
| 10 | PCSRLLPSLRCSLHS (SEQ ID NO: 6045) | 10 |
| 15 | LPSLRCSLHSACCSG (SEQ ID NO: 6046) | 10 |
| 1 | TCATPAGPMPCSRLL (SEQ ID NO: 6047) | 8 |
| 5 | PAGPMPCSRLLPSLR (SEQ ID NO: 6048) | 8 |
| 7 | GPMPCSRLLPSLRCS (SEQ ID NO: 6049) | 8 |
| 14 | LLPSLRCSLHSACCS (SEQ ID NO: 6050) | 8 |

TABLE XLVI

V20-HLA-DRB1-0101-15mers-PSCA
Each peptide is a portion of SEQ
ID NO: 8; each start position is
specified, the length of peptide is
15 amino acids, and the end
position for each peptide is the
start position plus fourteen.

| Pos | 123456789012345 | score |
|---|---|---|
| 11 | DPASSRLWGAPLQPT (SEQ ID NO: 6051) | 24 |

TABLE XLVI-continued

V20-HLA-DRB1-0101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 15 | SRLWGAPLQPTLGVV (SEQ ID NO: 6052) | 18 |
| 2 | SLHSACCSGDPASSR (SEQ ID NO: 6053) | 16 |
| 1 | CSLHSACCSGDPASS (SEQ ID NO: 6054) | 14 |
| 4 | HSACCSGDPASSRLW (SEQ ID NO: 6055) | 14 |
| 6 | ACCSGDPASSRLWGA (SEQ ID NO: 6056) | 14 |
| 13 | ASSRLWGAPLQPTLG (SEQ ID NO: 6057) | 14 |
| 12 | PASSRLWGAPLQPTL (SEQ ID NO: 6058) | 12 |

TABLE XLVI

V21-HLA-DRB1-0101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 1 | TLGVVPQASVPLLTD (SEQ ID NO: 6059) | 29 |
| 6 | PQASVPLLTDPAQWE (SEQ ID NO: 6060) | 23 |
| 7 | QASVPLLTDPAQWEP (SEQ ID NO: 6061) | 17 |
| 10 | VPLLTDPAQWEPVLV (SEQ ID NO: 6062) | 17 |
| 2 | LGVVPQASVPLLTDP (SEQ ID NO: 6063) | 16 |
| 9 | SVPLLTDPAQWEPVL (SEQ ID NO: 6064) | 16 |

TABLE XLVI-continued

V21-HLA-DRB1-0101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 13 | LTDPAQWEPVLVPEA (SEQ ID NO: 6065) | 15 |
| 12 | LLTDPAQWEPVLVPE (SEQ ID NO: 6066) | 14 |

TABLE XLVI

V21&22-HLA-DRB1-0101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 9 | VPLLTDLAQWEPVLV (SEQ ID NO: 6067) | 25 |
| 15 | LAQWEPVLVPEAHPN (SEQ ID NO: 6068) | 24 |
| 5 | PQASVPLLTDLAQWE (SEQ ID NO: 6069) | 23 |
| 12 | LTDLAQWEPVLVPEA (SEQ ID NO: 6070) | 23 |
| 6 | QASVPLLTDLAQWEP (SEQ ID NO: 6071) | 17 |
| 1 | LGVVPQASVPLLTDL (SEQ ID NO: 6072) | 16 |
| 8 | SVPLLTDLAQWEPVL (SEQ ID NO: 6073) | 16 |
| 11 | LLTDLAQWEPVLVPE (SEQ ID NO: 6074) | 14 |

TABLE XLVI

V22-HLA-DRB1-0101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 9 | VPLLTHLAQWEPVLV (SEQ ID NO: 6074) | 25 |
| 15 | LAQWEPVLVPEAHPN (SEQ ID NO: 6075) | 24 |
| 5 | PQASVPLLTHLAQWE (SEQ ID NO: 6076) | 23 |
| 12 | LTHLAQWEPVLVPEA (SEQ ID NO: 6077) | 23 |
| 6 | QASVPLLTHLAQWEP (SEQ ID NO: 6078) | 17 |
| 1 | LGVVPQASVPLLTHL (SEQ ID NO: 6079) | 16 |
| 8 | SVPLLTHLAQWEPVL (SEQ ID NO: 6080) | 16 |
| 11 | LLTHLAQWEPVLVPE (SEQ ID NO: 6081) | 14 |

TABLE XLVI

V24-HLA-DRB1-0101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 14 | CTPVPHPDPPMALSR (SEQ ID NO: 6082) | 22 |
| 7 | ASLTMYVCTPVPHPD (SEQ ID NO: 6083) | 20 |
| 6 | NASLTMYVCTPVPHP (SEQ ID NO: 6084) | 19 |
| 9 | LTMYVCTPVPHPDPP (SEQ ID NO: 6085) | 19 |
| 2 | EAHPNASLTMYVCTP (SEQ ID NO: 6086) | 15 |
| 11 | MYVCTPVPHPDPPMA (SEQ ID NO: 6087) | 15 |
| 5 | PNASLTMYVCTPVPH (SEQ ID NO: 6088) | 14 |
| 8 | SLTMYVCTPVPHPDP (SEQ ID NO: 6089) | 14 |
| 10 | TMYVCTPVPHPDPPM (SEQ ID NO: 6090) | 14 |
| 12 | YVCTPVPHPDPPMAL (SEQ ID NO: 6091) | 14 |
| 15 | TPVPHPDPPMALSRT (SEQ ID NO: 6092) | 14 |

TABLE XLVI

V25-HLA-DRB1-0101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 11 | TRQISSIDTDPPADG (SEQ ID NO: 6093) | 28 |
| 3 | PMALSRTPTRQISSI (SEQ ID NO: 6094) | 23 |
| 15 | SSIDTDPPADGPSNP (SEQ ID NO: 6095) | 19 |
| 1 | DPPMALSRTPTRQIS (SEQ ID NO: 6096) | 15 |
| 8 | RTPTRQISSIDTDPP (SEQ ID NO: 6097) | 14 |
| 14 | ISSIDTDPPADGPSN (SEQ ID NO: 6098) | 14 |
| 7 | SRTPTRQISSIDTDP (SEQ ID NO: 6099) | 13 |

TABLE XLVI

V25&26-HLA-DRB41-0101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 1 | PMALSRTPTRQISSS (SEQ ID NO: 6100) | 23 |
| 9 | TRQISSSDTDPPADG (SEQ ID NO: 6101) | 22 |
| 13 | SSSDTDPPADGPSNP (SEQ ID NO: 6102) | 19 |
| 6 | RTPTRQISSSDTDPP (SEQ ID NO: 6103) | 14 |
| 5 | SRTPTRQISSSDTDP (SEQ ID NO: 6104) | 13 |

TABLE XLVI

V26-HLA-DRB1-0101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 1 | PMALSRTPTRQIGSS (SEQ ID NO: 6105) | 23 |
| 9 | TRQIGSSDTDPPADG (SEQ ID NO: 6106) | 22 |
| 13 | GSSDTDPPADGPSNP (SEQ ID NO: 6107) | 19 |
| 5 | SRTPTRQIGSSDTDP (SEQ ID NO: 6108) | 15 |
| 6 | RTPTRQIGSSDTDPP (SEQ ID NO: 6109) | 15 |
| 3 | ALSRTPTRQIGSSDT (SEQ ID NO: 6110) | 11 |

TABLE XLVI

V27-HLA-DRB1-0101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 1 | VVSPAPSRQQALRRA (SEQ ID NO: 6111) | 8 |

TABLE XLVII

V1-HLA-DRB1-0301-15mers-PSCA
Each peptide is a portion of SEQ ID NO: 2; each start position is specified, the length of peptide is 15 amino acids, and the end position for each peptide is the start position plus fourteen.

| Pos | 123456789012345 | score |
|---|---|---|
| 67 | SLNCVDDSQDYYVGK (SEQ ID NO: 6112) | 26 |
| 106 | ILALLPALGLLLWGP (SEQ ID NO: 6113) | 24 |
| 2 | KAVLLALLMAGLALQ (SEQ ID NO: 6114) | 22 |
| 10 | MAGLALQPGTALLCY (SEQ ID NO: 6115) | 21 |
| 104 | AAILALLPALGLLLW (SEQ ID NO: 6116) | 21 |
| 66 | CSLNCVDDSQDYYVG (SEQ ID NO: 6117) | 19 |
| 33 | EDCLQVENCTQLGEQ (SEQ ID NO: 6118) | 18 |
| 56 | VGLLTVISKGCSLNC (SEQ ID NO: 6119) | 18 |
| 19 | TALLCYSCKAQVSNE (SEQ ID NO: 6120) | 17 |
| 35 | CLQVENCTQLGEQCW (SEQ ID NO: 6121) | 17 |
| 5 | LLALLMAGLALQPGT (SEQ ID NO: 6122) | 16 |
| 1 | MKAVLLALLMAGLAL (SEQ ID NO: 6123) | 15 |

TABLE XLVII-continued

V1-HLA-DRB1-0301-15mers-PSCA
Each peptide is a portion of SEQ ID NO: 2; each start position is specified, the length of peptide is 15 amino acids, and the end position for each peptide is the start position plus fourteen.

| Pos | 123456789012345 | score |
|---|---|---|
| 103 | AAAILALLPALGLLL (SEQ ID NO: 6124) | 15 |
| 18 | GTALLCYSCKAQVSN (SEQ ID NO: 6125) | 14 |
| 25 | SCKAQVSNEDCLQVE (SEQ ID NO: 6126) | 14 |
| 58 | LLTVISKGCSLNCVD (SEQ ID NO: 6127) | 14 |
| 4 | VLLALLMAGLALQPG (SEQ ID NO: 6128) | 13 |
| 11 | AGLALQPGTALLCYS (SEQ ID NO: 6129) | 13 |
| 12 | GLALQPGTALLCYSC (SEQ ID NO: 6130) | 13 |
| 50 | TARIRAVGLLTVISK (SEQ ID NO: 6131) | 13 |
| 84 | ITCCDTDLCNASGAH (SEQ ID NO: 6132) | 13 |
| 107 | LALLPALGLLLWGPG (SEQ ID NO: 6133) | 13 |
| 3 | AVLLALLMAGLALQP (SEQ ID NO: 6134) | 12 |
| 6 | LALLMAGLALQPGTA (SEQ ID NO: 6135) | 12 |
| 28 | AQVSNEDCLQVENCT (SEQ ID NO: 6136) | 12 |
| 41 | CTQLGEQCWTARIRA (SEQ ID NO: 6137) | 12 |
| 55 | AVGLLTVISKGCSLN (SEQ ID NO: 6138) | 12 |
| 59 | LTVISKGCSLNCVDD (SEQ ID NO: 6139) | 12 |
| 81 | KKNITCCDTDLCNAS (SEQ ID NO: 6140) | 12 |

TABLE XLVII-continued

V1-HLA-DRB1-0301-15mers-PSCA
Each peptide is a portion of SEQ ID NO: 2; each start position is specified, the length of peptide is 15 amino acids, and the end position for each peptide is the start position plus fourteen.

| Pos | 123456789012345 | score |
|---|---|---|
| 88 | DTDLCNASGAHALQP (SEQ ID NO: 6141) | 12 |
| 97 | AHALQPAAAILALLP (SEQ ID NO: 6142) | 12 |
| 102 | PAAAILALLPALGLL (SEQ ID NO: 6143) | 12 |
| 105 | AILALLPALGLLLWG (SEQ ID NO: 6144) | 12 |

TABLE XLVII

V4-HLA-DRB1-0301-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 144 | FSTLNPVLRHLFPQE (SEQ ID NO: 6145) | 27 |
| 29 | CSRLPPSLRCSLHSA (SEQ ID NO: 6146) | 26 |
| 119 | IGSIDTDPPAOGPSN (SEQ ID NO: 6147) | 22 |
| 62 | TLGVVPQASVPLLTH (SEQ ID NO: 6148) | 21 |
| 100 | APVPHPDPPMALSRT (SEQ ID NO: 6149) | 21 |
| 63 | LGVVPQASVPLLTHP (SEQ ID NO: 6150) | 21 |
| 60 | QPTLGVVPQASVPLL (SEQ ID NO: 6151) | 18 |
| 162 | AHPIYDLSQVWSVVS (SEQ ID NO: 6152) | 18 |
| 71 | VPLLTHPAQWEPVLV (SEQ ID NO: 6153) | 17 |

TABLE XLVII-continued

V4-HLA-DRB1-0301-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 149 | PVLRHLFPQEAFPAH (SEQ ID NO: 6154) | 17 |
| 157 | QEAFPAHPIYDLSQV (SEQ ID NO: 6155) | 17 |
| 83 | VLVPEAHPNASLTMY (SEQ ID NO: 6156) | 16 |
| 136 | CCCFHGPAFSTLNPV (SEQ ID NO: 6157) | 16 |
| 140 | HGPAFSTLNPVLRHL (SEQ ID NO: 6158) | 16 |
| 52 | YRLWGAPLQPTLGVV (SEQ ID NO: 6159) | 15 |
| 70 | SVPLLTHPAQWEPVL (SEQ ID NO: 6160) | 14 |
| 73 | LLTHPAQWEPVLVPE (SEQ ID NO: 6161) | 14 |
| 33 | PPSLRCSLHSACCSG (SEQ ID NO: 6162) | 13 |
| 56 | GAPLQPTLGVVPQAS (SEQ ID NO: 6163) | 13 |
| 80 | WEPVLVPEAHPNASL (SEQ ID NO: 6164) | 13 |
| 81 | EPVLVPEAHPNASLT (SEQ ID NO: 6165) | 13 |
| 82 | PVLVPEAHPNASLTM (SEQ ID NO: 6166) | 13 |
| 91 | NASLTMYVCAPVPHP (SEQ ID NO: 6167) | 13 |
| 147 | LNPVLRHLFPQEAFP (SEQ ID NO: 6168) | 13 |
| 161 | PAHPIYDLSQVWSVV (SEQ ID NO: 6169) | 13 |

TABLE XLVII

V19-HLA-DR1-0301-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 11 | CSRLLPSLRCSLHSA (SEQ ID NO: 6170) | 28 |
| 15 | LPSLRCSLHSACCSG (SEQ ID NO: 6171) | 13 |

TABLE XLVII

V20-HLA-DR1-0301-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 15 | SRLWGAPLQPTLGVV (SEQ ID NO: 6172) | 15 |
| 14 | SSRLWGAPLQPTLGV (SEQ ID NO: 6173) | 12 |
| 5 | SACCSGDPASSRLWG (SEQ ID NO: 6174) | 11 |
| 11 | DPASSRLWGAPLQPT (SEQ ID NO: 6175) | 9 |
| 6 | ACCSGDPASSRLWGA (SEQ ID NO: 6176) | 8 |
| 8 | CSGDPASSRLWGAPL (SEQ ID NO: 6177) | 8 |

TABLE XLVII

V21-HLA-DR1-0301-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 9 | SVPLLTDPAQWEPVL (SEQ ID NO: 6178) | 24 |
| 1 | TLGVVPQASVPLLTD (SEQ ID NO: 6179) | 21 |

TABLE XLVII-continued

V21-HLA-DR1-0301-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 2 | LGVVPQASVPLLTDP (SEQ ID NO: 6180) | 20 |
| 10 | VPLLTDPAQWEPVLV (SEQ ID NO: 6181) | 17 |
| 12 | LLTDPAQWEPVLVPE (SEQ ID NO: 6182) | 14 |
| 7 | QASVPLLTDPAQWEP (SEQ ID NO: 6183) | 12 |

TABLE XLVII

V21&22-HLA-DR1-0301-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 8 | SVPLLTDLAQWEPVL (SEQ ID NO: 6184) | 24 |
| 1 | LGVVPQASVPLLTDL (SEQ ID NO: 6185) | 20 |
| 9 | VPLLTDLAQWEPVLV (SEQ ID NO: 6186) | 17 |
| 11 | LLTDLAQWEPVLVPE (SEQ ID NO: 6187) | 16 |
| 6 | QASVPLLTDLAQWEP (SEQ ID NO: 6188) | 13 |
| 12 | LTDLAQWEPVLVPEA (SEQ ID NO: 6189) | 13 |

TABLE XLVII

V22-HLA-DR1-0301-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 1 | LGVVPQASVPLLTHL (SEQ ID NO: 6190) | 20 |
| 9 | VPLLTHLAQWEPVLV (SEQ ID NO: 6191) | 17 |
| 11 | LLTHLAQWEPVLVPE (SEQ ID NO: 6192) | 16 |
| 8 | SVPLLTHLAQWEPVL (SEQ ID NO: 6193) | 14 |
| 6 | QASVPLLTHLAQWEP (SEQ ID NO: 6194) | 13 |
| 12 | LTHLAQWEPVLVPEA (SEQ ID NO: 6195) | 13 |
| 4 | VPQASVPLLTHLAQW (SEQ ID NO: 6196) | 9 |

TABLE XLVII

V24-HLA-DR1-0301-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 15 | TPVPHPDPPMALSRT (SEQ ID NO: 6197) | 21 |
| 6 | NASLTMYVCTPVPHP (SEQ ID NO: 6198) | 12 |
| 8 | SLTMYVCTPVPHPDP (SEQ ID NO: 6199) | 11 |
| 10 | TMYVCTPVPHPDPPM (SEQ ID NO: 6200) | 10 |
| 14 | CTPVPHPDPPMALSR (SEQ ID NO: 6201) | 10 |

TABLE XLVII

V25-HLA-DR1-0301-15mers-PSCA
Each peptide is a portion of SEQ
ID NO: 8; each start psoition is
specified, the lenght of peptide is
15 amino acids, and the end
position for each peptide is the
start position plus fourteen.

| Pos | 123456789012345 | score |
|---|---|---|
| 14 | ISSIDTDPPADGPSN (SEQ ID NO: 6202) | 22 |
| 1 | DPPMALSRTPTRQIS (SEQ ID NO: 6203) | 11 |
| 3 | PMALSRTPTRQISSI (SEQ ID NO: 6204) | 11 |
| 11 | TRQISSIDTDPPADG (SEQ ID NO: 6205) | 11 |
| 12 | RQISSIDTDPPADGP (SEQ ID NO: 6206) | 10 |
| 12 | ISSSDTDPPADGPSN (SEQ ID NO: 6207) | 12 |
| 1 | PMALSRTPTRQISSS (SEQ ID NO: 6208) | 11 |
| 9 | TRQISSSDTDPPADG (SEQ ID NO: 6209) | 11 |
| 10 | RQISSSDTDPPADGP (SEQ ID NO: 6210) | 11 |
| 2 | MALSRTPTRQISSSD (SEQ ID NO: 6211) | 8 |
| 3 | ALSRTPTRQISSSDT (SEQ ID NO: 6212) | 8 |

Table XLVII

V26-HLA-DR1-0301-15mers-PSCA
Each peptide is a portion of SEQ
ID NO: 8; each start position is
specified, the length of peptide is
15 amino acids, and the end
position for each peptide is the
start position plus fourteen.

| Pos | 123456789012345 | score |
|---|---|---|
| 12 | IGSSDTDPPADGPSN (SEQ ID NO: 6213) | 12 |
| 1 | PMALSRTPTRQIGSS (SEQ ID NO: 6214) | 11 |

Table XLVII-continued

V26-HLA-DR1-0301-15mers-PSCA
Each peptide is a portion of SEQ
ID NO: 8; each start position is
specified, the length of peptide is
15 amino acids, and the end
position for each peptide is the
start position plus fourteen.

| Pos | 123456789012345 | score |
|---|---|---|
| 9 | TRQIGSSDTDPPADG (SEQ ID NO: 6215) | 11 |
| 10 | RQIGSSDTDPPADGP (SEQ ID NO: 6216) | 11 |
| 2 | MALSRTPTRQIGSSD (SEQ ID NO: 6217) | 8 |
| 3 | ALSRTPTRQIGSSDT (SEQ ID NO: 6218) | 8 |

TABLE XLVII

V27-HLA-DR1-0301-15mers-PSCA
Each peptide is a portion of SEQ
ID NO: 8; each start position is
specified, the length of peptide is
15 amino acids, and the end
position for each peptide is the
start position plus fourteen.

| Pos | 123456789012345 | score |
|---|---|---|
| 1 | VVSPAPSRQQALRRA (SEQ ID NO: 6219) | 17 |
| 2 | VSPAPSRQQALRRAQ (SEQ ID NO: 6220) | 9 |

TABLE XLVIII

V1-HLA-DR1-0401-15mers-PSCA
Each peptide is a portion of SEQ ID
NO: 2; each start position is
specified, the length of peptide is
15 amino acids, and the end
position for each peptide is the start
position plus fourteen.

| Pos | 123456789012345 | score |
|---|---|---|
| 2 | KAVLLALLMAGLALQ (SEQ ID NO: 6221) | 20 |
| 3 | AVLLALLMAGLALQP (SEQ ID NO: 6222) | 20 |
| 5 | LLALLMAGLALQPGT (SEQ ID NO: 6223) | 20 |
| 27 | KAQVSNEDCLQVENC (SEQ ID NO: 6224) | 20 |

TABLE XLVIII-continued

V1-HLA-DR1-0401-15mers-PSCA
Each peptide is a portion of SEQ ID
NO: 2; each start position is
specified, the length of peptide is
15 amino acids, and the end
position for each peptide is the start
position plus fourteen.

| Pos | 123456789012345 | score |
|---|---|---|
| 33 | EDCLQVENCTQLGEQ (SEQ ID NO: 6225) | 20 |
| 50 | TARIRAVGLLTVISK (SEQ ID NO: 6226) | 20 |
| 53 | IRAVGLLTVISKGCS (SEQ ID NO: 6227) | 20 |
| 55 | AVGLLTVISKGCSLN (SEQ ID NO: 6228) | 20 |
| 56 | VGLLTVISKGCSLNC (SEQ ID NO: 6229) | 20 |
| 88 | DTDLCNASGAHALQP (SEQ ID NO: 6230) | 20 |
| 97 | AHALQPAAAILALLP (SEQ ID NO: 6231) | 20 |
| 104 | AAILALLPALGLLLW (SEQ ID NO: 6232) | 20 |
| 106 | ILALLPALGLLLWGP (SEQ ID NO: 6233) | 20 |
| 8 | LLMAGLALQPGTALL (SEQ ID NO: 6234) | 18 |
| 32 | NEDCLQVENCTQLGE (SEQ ID NO: 6235) | 18 |
| 52 | RIRAVGLLTVISKGC (SEQ ID NO: 6236) | 18 |
| 93 | NASGAHALQPAAAIL (SEQ ID NO: 6237) | 18 |
| 21 | LLCYSCKAQVSNEDC (SEQ ID NO: 6238) | 17 |
| 74 | SQDYYVGKKNITCCD (SEQ ID NO: 6239) | 16 |
| 1 | MKAVLLALLMAGLAL (SEQ ID NO: 6240) | 14 |
| 7 | ALLMAGLALQPGTAL (SEQ ID NO: 6241) | 14 |

TABLE XLVIII-continued

V1-HLA-DR1-0401-15mers-PSCA
Each peptide is a portion of SEQ ID
NO: 2; each start position is
specified, the length of peptide is
15 amino acids, and the end
position for each peptide is the start
position plus fourteen.

| Pos | 123456789012345 | score |
|---|---|---|
| 10 | MAGLALQPGTALLCY (SEQ ID NO: 6242) | 14 |
| 18 | GTALLCYSCKAQVSN (SEQ ID NO: 6243) | 14 |
| 19 | TALLCYSCKAQVSNE (SEQ ID NO: 6244) | 14 |
| 35 | CLQVENCTQLGEQCW (SEQ ID NO: 6245) | 14 |
| 59 | LTVISKGCSLNCVDD (SEQ ID NO: 6246) | 14 |
| 65 | GCSLNCVDDSQDYYV (SEQ ID NO: 6247) | 14 |
| 68 | LNCVDDSQDYYVGKK (SEQ ID NO: 6248) | 14 |
| 81 | KKNITCCDTDLCNAS (SEQ ID NO: 6249) | 14 |
| 103 | AAAILALLPALGLLL (SEQ ID NO: 6250) | 14 |
| 107 | LALLPALGLLLWGPG (SEQ ID NO: 6251) | 14 |
| 9 | LMAGLALQPGTALLC (SEQ ID NO: 6252) | 12 |
| 11 | AGLALQPGTALLCYS (SEQ ID NO: 6253) | 12 |
| 14 | ALQPGTALLCYSCKA (SEQ ID NO: 6254) | 12 |
| 16 | QPGTALLCYSCKAQV (SEQ ID NO: 6255) | 12 |
| 17 | PGTALLCYSCKAQVS (SEQ ID NO: 6256) | 12 |
| 24 | YSCKAQVSNEDCLQV (SEQ ID NO: 6257) | 12 |
| 29 | QVSNEDCLQVENCTQ (SEQ ID NO: 6258) | 12 |

TABLE XLVIII-continued

V1-HLA-DR1-0401-15mers-PSCA
Each peptide is a portion of SEQ ID
NO: 2; each start position is
specified, the length of peptide is
15 amino acids, and the end
position for each peptide is the start
position plus fourteen.

| Pos | 123456789012345 | score |
|---|---|---|
| 39 | ENCTQLGEQCWTARI (SEQ ID NO: 6259) | 12 |
| 40 | NCTQLGEQCWTARIR (SEQ ID NO: 6260) | 12 |
| 42 | TQLGEQCWTARIRAV (SEQ ID NO: 6261) | 12 |
| 44 | LGEQCWTARIRAVGL (SEQ ID NO: 6262) | 12 |
| 45 | GEQCWTARIRAVGLL (SEQ ID NO: 6263) | 12 |
| 47 | QCWTARIRAVGLLTV (SEQ ID NO: 6264) | 12 |
| 49 | WTARIRAVGLLTVIS (SEQ ID NO: 6265) | 12 |
| 66 | CSLNCVDDSQDYYVG (SEQ ID NO: 6266) | 12 |
| 67 | SLNCVDDSQDYYVGK (SEQ ID NO: 6267) | 12 |
| 70 | CVDDSQDYYVGKKNI (SEQ ID NO: 6268) | 12 |
| 73 | DSQDYYVGKKNITCC (SEQ ID NO: 6269) | 12 |
| 78 | YVGKKNITCCDTDLC (SEQ ID NO: 6270) | 12 |
| 82 | KNITCCDTDLCNASG (SEQ ID NO: 6271) | 12 |
| 84 | ITCCDTDLCNASGAH (SEQ ID NO: 6272) | 12 |
| 85 | TCCDTDLCNASGAHA (SEQ ID NO: 6273) | 12 |
| 90 | DLCNASGAHALQPAA (SEQ ID NO: 6274) | 12 |
| 94 | ASGAHALQPAAAILA (SEQ ID NO: 6275) | 12 |
| 98 | HALQPAAAILALLPA (SEQ ID NO: 6276) | 12 |
| 99 | ALQPAAAILALLPAL (SEQ ID NO: 6277) | 12 |
| 101 | QPAAAILALLPALGL (SEQ ID NO: 6278) | 12 |
| 102 | PAAAILALLPALGLL (SEQ ID NO: 6279) | 12 |
| 46 | EQCWTARIRAVGLLT (SEQ ID NO: 6280) | 11 |
| 75 | QDYYVGKKNITCCDT (SEQ ID NO: 6281) | 11 |
| 58 | LLTVISKGCSLNCVD (SEQ ID NO: 6282) | 9 |

TABLE XLVIII

V4-HLA-DR1-0401-15mers-PSCA
Each peptide is a portion of SEQ ID NO: 8;
each start position is specified, the
length of peptide is 15 amino acids, and
the end position for each peptide is the
start position plus fourteen.

| Pos | 123456789012345 | score |
|---|---|---|
| 60 | QPTLGVVPQASVPLL (SEQ ID NO: 6283) | 26 |
| 68 | QASVPLLTHPAQWEP (SEQ ID NO: 6284) | 26 |
| 81 | EPVLVPEAHPNASLT (SEQ ID NO: 6285) | 26 |
| 162 | AHPIYDLSQVWSVVS (SEQ ID NO: 6286) | 26 |
| 165 | IYDLSQVWSVVSPAP (SEQ ID NO: 6287) | 26 |
| 172 | WSWSPAPSRGQALRI (SEQ ID NO: 6288) | 26 |
| 52 | YRLWGAPLQPTLGVV (SEQ ID NO: 6289) | 22 |

TABLE XLVIII-continued

V4-HLA-DR1-0401-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 77  | PAQWEPVLVPEAHPN (SEQ ID NO: 6290) | 22 |
| 169 | SQVWSVVSPAPSRGQ (SEQ ID NO: 6291) | 22 |
| 29  | CSRLPPSLRCSLHSA (SEQ ID NO: 6292) | 20 |
| 51  | SYRLWGAPLQPTLGV (SEQ ID NO: 6293) | 20 |
| 62  | TLGVVPQASVPLLTH (SEQ ID NO: 6294) | 20 |
| 63  | LGVVPQASVPLLTHP (SEQ ID NO: 6295) | 20 |
| 82  | PVLVPEAHPNASLTM (SEQ ID NO: 6296) | 20 |
| 108 | PMALSRTPTRQIGSI (SEQ ID NO: 6297) | 20 |
| 116 | TRQIGSIDTDPPADG (SEQ ID NO: 6298) | 20 |
| 132 | SNPLCCCFHGPAFST (SEQ ID NO: 6299) | 20 |
| 144 | FSTLNPVLRHLFPQE (SEQ ID NO: 6300) | 20 |
| 148 | NPVLRHLFPQEAFPA (SEQ ID NO: 6301) | 20 |
| 168 | LSQVWSVVSPAPSRG (SEQ ID NO: 6302) | 20 |
| 67  | PQASVPLLTHPAQWE (SEQ ID NO: 6303) | 18 |
| 105 | PDPPMALSRTPTRQI (SEQ ID NO: 6304) | 18 |
| 113 | RTPTRQIGSIDTDPP (SEQ ID NO: 6305) | 18 |
| 137 | CCFHGPAFSTLNPVL (SEQ ID NO: 6306) | 18 |

TABLE XLVIII-continued

V4-HLA-DR1-0401-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 5   | TTTWARRTSRAVTPT (SEQ ID NO: 6307) | 17 |
| 49  | PASYRLWGAPLQPTL (SEQ ID NO: 6308) | 16 |
| 94  | LTMYVCAPVPHPDPP (SEQ ID NO: 6309) | 16 |
| 136 | CCCFHGPAFSTLNPV (SEQ ID NO: 6310) | 16 |
| 141 | GPAFSTLNPVLRHLF (SEQ ID NO: 6311) | 16 |
| 152 | RHLFPQEAFPAHPIY (SEQ ID NO: 6312) | 16 |
| 157 | QEAFPAHPIYDLSQV (SEQ ID NO: 6313) | 16 |
| 163 | HPIYDLSQVWSVVSP (SEQ ID NO: 6314) | 16 |
| 13  | SRAVTPTCATPAGPM (SEQ ID NO: 6315) | 14 |
| 24  | AGPMPCSRLPPSLRC (SEQ ID NO: 6316) | 14 |
| 3   | PPSLRCSLHSACCSG (SEQ ID NO: 6317) | 14 |
| 37  | RCSLHSACCSGDPAS (SEQ ID NO: 6318) | 14 |
| 71  | VPLLTHPAQWEPVLV (SEQ ID NO: 6319) | 14 |
| 80  | WEPVLVPEAHPNASL (SEQ ID NO: 6320) | 14 |
| 91  | NASLTMYVCAPVPHP (SEQ ID NO: 6321) | 14 |
| 99  | CAPVPHPDPPMALSR (SEQ ID NO: 6322) | 14 |
| 106 | DPPMALSRTPTRQIG (SEQ ID NO: 6323) | 14 |

TABLE XLVIII-continued

V4-HLA-DR1-0401-15mers-PSCA
Each peptide is a portion of SEQ ID NO: 8;
each start position is specified, the
length of peptide is 15 amino acids, and
the end position for each peptide is the
start position plus fourteen.

| Pos | 123456789012345 | score |
|---|---|---|
| 119 | IGSIDTDPPADGPSN (SEQ ID NO: 6324) | 14 |
| 151 | LRHLFPQEAFPAHPI (SEQ ID NO: 6325) | 14 |
| 2 | THRTTTWARRTSRAV (SEQ ID NO: 6326) | 12 |
| 3 | HRTTTWARRTSRAVT (SEQ ID NO: 6327) | 12 |
| 6 | TTWARRTSRAVTPTC (SEQ ID NO: 6328) | 12 |
| 9 | ARRTSRAVTPTCATP (SEQ ID NO: 6329) | 12 |
| 10 | RRTSRAVTPTCATPA (SEQ ID NO: 6330) | 12 |
| 11 | RTSRAVTPTCATPAG (SEQ ID NO: 6331) | 12 |
| 34 | PSLRCSLHSACCSGD (SEQ ID NO: 6332) | 12 |
| 43 | ACCSGDPASYRLWGA (SEQ ID NO: 6333) | 12 |
| 48 | DPASYRLWGAPLQPT (SEQ ID NO: 6334) | 12 |
| 54 | LWGAPLQPTLGVVPQ (SEQ ID NO: 6335) | 12 |
| 57 | APLQPTLGVVPQASV (SEQ ID NO: 6336) | 12 |
| 59 | LQPTLGVVPQASVPL (SEQ ID NO: 6337) | 12 |
| 72 | PLLTHPAQWEPVLVP (SEQ ID NO: 6338) | 12 |
| 83 | VLVPEAHPNASLTMY (SEQ ID NO: 6339) | 12 |
| 85 | VPEAHPNASLTMYVC (SEQ ID NO: 6340) | 12 |

TABLE XLVIII-continued

V4-HLA-DR1-0401-15mers-PSCA
Each peptide is a portion of SEQ ID NO: 8;
each start position is specified, the
length of peptide is 15 amino acids, and
the end position for each peptide is the
start position plus fourteen.

| Pos | 123456789012345 | score |
|---|---|---|
| 87 | EAHPNASLTMYVCAP (SEQ ID NO: 6341) | 12 |
| 96 | MYVCAPVPHPDPPMA (SEQ ID NO: 6342) | 12 |
| 100 | APVPHPDPPMALSRT (SEQ ID NO: 6343) | 12 |
| 104 | HPDPPMALSRTPTRQ (SEQ ID NO: 6344) | 12 |
| 110 | ALSRTPTRQIGSIDT (SEQ ID NO: 6345) | 12 |
| 117 | RQIGSIDTDPPADGP (SEQ ID NO: 6346) | 12 |
| 122 | IDTDPPADGPSNPLC (SEQ ID NO: 6347) | 12 |
| 124 | TDPPADGPSNPLCCC (SEQ ID NO: 6348) | 12 |
| 138 | CFHGPAFSTLNPVLR (SEQ ID NO: 6349) | 12 |
| 140 | HGPAFSTLNPVLRHL (SEQ ID NO: 6350) | 12 |
| 145 | STLNPVLRHLFPQEA (SEQ ID NO: 6351) | 12 |
| 149 | PVLRHLFPQEAFPAH (SEQ ID NO: 6352) | 12 |
| 154 | LFPQEAFPAHPIYDL (SEQ ID NO: 6353) | 12 |
| 159 | AFPAHPIYDLSQVWS (SEQ ID NO: 6354) | 12 |
| 161 | PAHPIYDLSQVWSVV (SEQ ID NO: 6355) | 12 |
| 173 | SVVSPAPSRGQALRR (SEQ ID NO: 6356) | 12 |

TABLE XLVIII

V19-HLA-DR1-0401-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 11 | CSRLLPSLRCSLHSA (SEQ ID NO: 6357) | 20 |
| 6 | AGPMPCSRLLPSLRC (SEQ ID NO: 6358) | 14 |
| 12 | SRLLPSLRCSLHSAC (SEQ ID NO: 6359) | 14 |
| 15 | LPSLRCSLHSACCSG (SEQ ID NO: 6360) | 14 |
| 4 | TPAGPMPCSRLLPSL (SEQ ID NO: 6361) | 12 |
| 9 | MPCSRLLPSLRCSLH (SEQ ID NO: 6362) | 12 |

TABLE XLVIII

V20-HLA-DR1-0401-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 15 | SRLWGAPLQPTLGVV (SEQ ID NO: 6363) | 22 |
| 14 | SSRLWGAPLQPTLGV (SEQ ID NO: 6364) | 20 |
| 6 | ACCSGDPASSRLWGA (SEQ ID NO: 6365) | 12 |
| 7 | CCSGDPASSRLWGAP (SEQ ID NO: 6366) | 12 |
| 11 | DPASSRLWGAPLQPT (SEQ ID NO: 6367) | 12 |

TABLE XLVIII

V21-HLA-DR1-0401-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 1 | TLGVVPQASVPLLTD (SEQ ID NO: 6368) | 20 |
| 2 | LGVVPQASVPLLTDP (SEQ ID NO: 6369) | 20 |
| 7 | QASVPLLTDPAQWEP (SEQ ID NO: 6370) | 20 |
| 6 | PQASVPLLTDPAQWE (SEQ ID NO: 6371) | 18 |
| 9 | SVPLLTDPAQWEPVL (SEQ ID NO: 6372) | 14 |
| 10 | VPLLTDPAQWEPVLV (SEQ ID NO: 6373) | 14 |
| 11 | PLLTDPAQWEPVLVP (SEQ ID NO: 6374) | 12 |

TABLE XLVIII

V21&22-HLA-DR1-0401-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 1 | LGVVPQASVPLLTDL (SEQ ID NO: 6375) | 20 |
| 6 | QASVPLLTDLAQWEP (SEQ ID NO: 6376) | 20 |
| 9 | VPLLTDLAQWEPVLV (SEQ ID NO: 6377) | 20 |
| 5 | PQASVPLLTDLAQWE (SEQ ID NO: 6378) | 18 |
| 8 | SVPLLTDLAQWEPVL (SEQ ID NO: 6379) | 14 |
| 12 | LTDLAQWEPVLVPEA (SEQ ID NO: 6380) | 14 |
| 10 | PLLTDLAQWEPVLVP (SEQ ID NO: 6381) | 12 |

TABLE XLVIII

V22-HLA-DR1-0401-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 6 | QASVPLLTHLAQWEP (SEQ ID NO: 6382) | 26 |
| 15 | LAQWEPVLVPEAHPN (SEQ ID NO: 6383) | 22 |
| 1 | LGVVPQASVPLLTHL (SEQ ID NO: 6384) | 20 |
| 9 | VPLLTHLAQWEPVLV (SEQ ID NO: 6385) | 20 |
| 5 | PQASVPLLTHLAQWE (SEQ ID NO: 6386) | 18 |
| 12 | LTHLAQWEPVLVPEA (SEQ ID NO: 6387) | 14 |
| 10 | PLLTHLAQWEPVLVP (SEQ ID NO: 6388) | 12 |

TABLE XLVIII

V24-HLA-DR1-0401-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 6 | NASLTMYVCTPVPHP (SEQ ID NO: 6389) | 14 |
| 14 | CTPVPHPDPPMALSR (SEQ ID NO: 6390) | 14 |
| 2 | EAHPNASLTMYVCTP (SEQ ID NO: 6391) | 12 |
| 7 | ASLTMYVCTPVPHPD (SEQ ID NO: 6392) | 12 |
| 11 | MYVCTPVPHPDPPMA (SEQ ID NO: 6393) | 12 |
| 15 | TPVPHPDPPMALSRT (SEQ ID NO: 6394) | 12 |
| 9 | LTMYVCTPVPHPDPP (SEQ ID NO: 6395) | 10 |

TABLE XLVIII-continued

V24-HLA-DR1-0401-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 8 | SLTMYVCTPVPHPDP (SEQ ID NO: 6396) | 8 |
| 10 | TMYVCTPVPHPDPPM (SEQ ID NO: 6397) | 8 |
| 1 | PEAHPNASLTMYVCT (SEQ ID NO: 6398) | 6 |
| 3 | AHPNASLTMYVCTPV (SEQ ID NO: 6399) | 6 |
| 7 | HPNASLTMYVCTPVP (SEQ ID NO: 6400) | 6 |
| 13 | VCTPVPHPDPPMALS (SEQ ID NO: 6401) | 6 |

TABLE XLVIII

V25-HLA-DR1-0401-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 3 | PMALSRTPTRQISSI (SEQ ID NO: 6402) | 20 |
| 11 | TRQISSIDTDPPADG (SEQ ID NO: 6403) | 20 |
| 8 | RTPTRQISSIDTDPP (SEQ ID NO: 6404) | 18 |
| 1 | DPPMALSRTPTRQIS (SEQ ID NO: 6405) | 14 |
| 14 | ISSIDTDPPADGPSN (SEQ ID NO: 6406) | 14 |
| 4 | MALSRTPTRQISSID (SEQ ID NO: 6407) | 12 |
| 5 | ALSRTPTRQISSIDT (SEQ ID NO: 6408) | 12 |
| 12 | RQISSIDTDPPADGP (SEQ ID NO: 6409) | 12 |

TABLE XLVIII

V25&26-HLA-DR1-0401-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 1 | PMALSRTPTRQISSS (SEQ ID NO: 6410) | 20 |
| 6 | RTPTRQISSSDTDPP (SEQ ID NO: 6411) | 18 |
| 9 | TRQISSSDTDPPADG (SEQ ID NO: 6412) | 14 |
| 2 | MALSRTPTRQISSSD (SEQ ID NO: 6413) | 12 |
| 3 | ALSRTPTRQISSSDT (SEQ ID NO: 6414) | 12 |
| 10 | RQISSSDTDPPADGP (SEQ ID NO: 6415) | 12 |

TABLE XLVIII

V26-HLA-DR1-0401-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 1 | PMALSRTPTRQIGSS (SEQ ID NO: 6416) | 20 |
| 6 | RTPTRQIGSSDTDPP (SEQ ID NO: 6417) | 18 |
| 9 | TRQIGSSDTDPPADG (SEQ ID NO: 6418) | 14 |
| 3 | ALSRTPTRQIGSSDT (SEQ ID NO: 6419) | 12 |
| 10 | RQIGSSDTDPPADGP (SEQ ID NO: 6420) | 12 |
| 15 | SDTDPPADGPSNPLC (SEQ ID NO: 6421) | 12 |

TABLE XLVIII

V27-HLA-DR1-0401-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 1 | VVSPAPSRQQALRRA (SEQ ID NO: 6422) | 12 |

TABLE XLIX

V1-HLA-DRB1-1101-15mers-PSCA
Each peptide is a portion of SEQ ID NO: 2; each start position is specified, the length of peptide is 15 amino acids, and the end position for each peptide is the start position plus fourteen.

| Pos | 123456789012345 | score |
|---|---|---|
| 56 | VGLLTVISKGCSLNC (SEQ ID NO: 6423) | 29 |
| 46 | EQCWTARIRAVGLLT (SEQ ID NO: 6424) | 27 |
| 74 | SQDYYVGKKNITCCD (SEQ ID NO: 6425) | 20 |
| 3 | AVLLALLMAGLALQP (SEQ ID NO: 6426) | 19 |
| 103 | AAAILALLPALGLLL (SEQ ID NO: 6427) | 19 |
| 7 | ALLMAGLALQPGTAL (SEQ ID NO: 6428) | 18 |
| 44 | LGEQCWTARIRAVGL (SEQ ID NO: 6429) | 16 |
| 19 | TALLCYSCKAQVSNE (SEQ ID NO: 6430) | 14 |
| 73 | DSQDYYVGKKNITCC (SEQ ID NO: 6431) | 14 |
| 85 | TCCDTDLCNASGAHA (SEQ ID NO: 6432) | 14 |

TABLE XLIX

V4-HLA-DRB1-1101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 169 | SQVWSVVSPAPSRGQ (SEQ ID NO: 6433) | 23 |
| 77 | PAQWEPVLVPEAHPN (SEQ ID NO: 6434) | 22 |
| 144 | FSTLNPVLRHLFPQE (SEQ ID NO: 6435) | 21 |
| 145 | STLNPVLRHLFPQEA (SEQ ID NO: 6436) | 21 |
| 68 | QASVPLLTHPAQWEP (SEQ ID NO: 6437) | 20 |
| 81 | EPVLVPEAHPNASLT (SEQ ID NO: 6438) | 20 |
| 96 | MYVCAPVPHPDPPMA (SEQ ID NO: 6439) | 20 |
| 132 | SNPLCCCFHGPAFST (SEQ ID NO: 6440) | 20 |
| 168 | LSQVWSVVSPAPSRG (SEQ ID NO: 6441) | 20 |
| 165 | IYDLSQVWSVVSPAP (SEQ ID NO: 6442) | 19 |
| 116 | TRQIGSIDTDPPADG (SEQ ID NO: 6443) | 18 |
| 148 | NPVLRHLFPQEAFPA (SEQ ID NO: 6444) | 18 |
| 162 | AHPIYDLSQVWSVVS (SEQ ID NO: 6445) | 18 |
| 2 | THRTTTWARRTSRAV (SEQ ID NO: 6446) | 17 |
| 141 | GPAFSTLNPVLRHLF (SEQ ID NO: 6447) | 17 |
| 94 | LTMYVCAPVPHPDPP (SEQ ID NO: 6448) | 16 |
| 109 | MALSRTPTRQIGSID (SEQ ID NO: 6449) | 15 |

TABLE XLIX-continued

V4-HLA-DRB1-1101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 13 | SRAVTPTCATPAGPM (SEQ ID NO: 6450) | 14 |
| 23 | PAGPMPCSRLPPSLR (SEQ ID NO: 6451) | 14 |
| 29 | CSRLPPSLRCSLHSA (SEQ ID NO: 6452) | 14 |
| 33 | PPSLRCSLHSACCSG (SEQ ID NO: 6453) | 14 |
| 45 | CSGDPASYRLWGAPL (SEQ ID NO: 6454) | 14 |
| 59 | LQPTLGVVPQASVPL (SEQ ID NO: 6455) | 14 |
| 71 | VPLLTHPAQWEPVLV (SEQ ID NO: 6456) | 14 |
| 105 | PDPPMALSRTPTRQI (SEQ ID NO: 6457) | 14 |
| 171 | VWSVVSPAPSRGQAL (SEQ ID NO: 6458) | 14 |
| 173 | SVVSPAPSRGQALRR (SEQ ID NO: 6459) | 14 |
| 53 | RLWGAPLQPTLGVVP (SEQ ID NO: 6460) | 13 |
| 56 | GAPLQPTLGVVPQAS (SEQ ID NO: 6461) | 13 |
| 60 | QPTLGVVPQASVPLL (SEQ ID NO: 6462) | 13 |
| 92 | ASLTMYVCAPVPHPD (SEQ ID NO: 6463) | 13 |
| 151 | LRHLFPQEAFPAHPI (SEQ ID NO: 6464) | 13 |
| 10 | RRTSRAVTPTCATPA (SEQ ID NO: 6465) | 12 |
| 24 | AGPMPCSRLPPSLRC (SEQ ID NO: 6466) | 12 |

TABLE XLIX-continued

V4-HLA-DRB1-1101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 67 | PQASVPLLTHPAQWE (SEQ ID NO: 6467) | 12 |
| 79 | QWEPVLVPEAHPNAS (SEQ ID NO: 6468) | 12 |
| 82 | PVLVPEAHPNASLTM (SEQ ID NO: 6469) | 12 |
| 90 | PNASLTMYVCAPVPH (SEQ ID NO: 6470) | 12 |
| 99 | PNASLTMYVCAPVPH (SEQ ID NO: 6471) | 12 |
| 119 | IGSIDTDPPADGPSN (SEQ ID NO: 6472) | 12 |
| 5 | TTTWARRTSRAVTPT (SEQ ID NO: 6473) | 11 |
| 49 | PASYRLWGAPLQPTL (SEQ ID NO: 6474) | 11 |

TABLE XLIX

V19-HLA-DRB1-1101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 5 | PAGPMPCSRLLPSLR (SEQ ID NO: 6475) | 15 |
| 11 | CSRLLPSLRCSLHSA (SEQ ID NO: 6476) | 14 |
| 15 | LPSLRCSLHSACCSG (SEQ ID NO: 6477) | 13 |
| 12 | SRLLPSLRCSLHSAC (SEQ ID NO: 6478) | 12 |
| 6 | AGPMPCSRLLPSLRC (SEQ ID NO: 6479) | 8 |

TABLE XLIX-continued

V19-HLA-DRB1-1101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 3 | ATPAGPMPCSRLLPS (SEQ ID NO: 6480) | 8 |
| 9 | MPCSRLLPSLRCSLH (SEQ ID NO: 6481) | 8 |
| 8 | PMPCSRLLPSLRCSL (SEQ ID NO: 6482) | 7 |
| 10 | PCSRLLPSLRCSLHS (SEQ ID NO: 6483) | 7 |

TABLE XLIX

V20-HLA-DRB1-1101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 8 | CSGDPASSRLWGAPL (SEQ ID NO: 6484) | 14 |
| 15 | SRLWGAPLQPTLGVV (SEQ ID NO: 6485) | 10 |
| 1 | CSLHSACCSGDPASS (SEQ ID NO: 6486) | 6 |
| 2 | SLHSACCSGDPASSR (SEQ ID NO: 6487) | 6 |
| 3 | LHSACCSGDPASSRL (SEQ ID NO: 6488) | 6 |
| 4 | HSACCSGDPASSRLW (SEQ ID NO: 6489) | 6 |
| 9 | SGDPASSRLWGAPLQ (SEQ ID NO: 6490) | 6 |
| 10 | GDPASSRLWGAPLQP (SEQ ID NO: 6491) | 6 |
| 11 | DPASSRLWGAPLQPT (SEQ ID NO: 6492) | 6 |

TABLE XLIX-continued

V20-HLA-DRB1-1101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 13 | ASSRLWGAPLQPTLG (SEQ ID NO: 6493) | 6 |
| 14 | SSRLWGAPLQPTLGV (SEQ ID NO: 6494) | 6 |
| 10 | VPLLTDPAQWEPVLV (SEQ ID NO: 6495) | 14 |
| 6 | PQASVPLLTDPAQWE (SEQ ID NO: 6496) | 12 |
| 7 | QASVPLLTDPAQWEP (SEQ ID NO: 6497) | 12 |
| 2 | LGVVPQASVPLLTDP (SEQ ID NO: 6498) | 7 |
| 5 | VPQASVPLLTDPAQW (SEQ ID NO: 6499) | 7 |
| 14 | TDPAQWEPVLVPEAH (SEQ ID NO: 6500) | 7 |
| 1 | TLGVVPQASVPLLTD (SEQ ID NO: 6501) | 6 |
| 4 | VVPQASVPLLTDPAQ (SEQ ID NO: 6502) | 6 |
| 9 | SVPLLTDPAQWEPVL (SEQ ID NO: 6503) | 6 |

TABLE XLIX

V21&22-HLA-DRB1-1101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 9 | VPLLTDLAQWEPVLV (SEQ ID NO: 6504) | 20 |
| 5 | PQASVPLLTDLAQWE (SEQ ID NO: 6505) | 13 |
| 6 | QASVPLLTDLAQWEP (SEQ ID NO: 6506) | 12 |

TABLE XLIX

V22-HLA-DRB1-1101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 15 | LAQWEPVLVPEAHPN (SEQ ID NO: 6507) | 22 |
| 6 | QASVPLLTHLAQWEP (SEQ ID NO: 6508) | 20 |
| 9 | VPLLTHLAQWEPVLV (SEQ ID NO: 6509) | 20 |
| 5 | PQASVPLLTHLAQWE (SEQ ID NO: 6510) | 13 |

TABLE XLIX

V24-HLA-DRB1-1101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 15 | MYVCTPVPHPDPPMA (SEQ ID NO: 6511) | 22 |
| 9 | LTMYVCTPVPHPDPP (SEQ ID NO: 6512) | 16 |
| 7 | ASLTMYVCTPVPHPD (SEQ ID NO: 6513) | 13 |
| 5 | PNASLTMYVCTPVPH (SEQ ID NO: 6514) | 12 |
| 14 | CTPVPHPDPPMALSR (SEQ ID NO: 6515) | 12 |
| 6 | NASLTMYVCTPVPHP (SEQ ID NO: 6516) | 10 |

TABLE XLIX

V25-HLA-DRB1-1101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 11 | TRQISSIDTDPPADG (SEQ ID NO: 6517) | 18 |
| 4 | MALSRTPTRQISSID (SEQ ID NO: 6518) | 15 |
| 14 | ISSIDTDPPADGPSN (SEQ ID NO: 6519) | 12 |
| 5 | ALSRTPTRQISSIDT (SEQ ID NO: 6520) | 81 |
| 15 | SSIDTDPPADGPSNP (SEQ ID NO: 6521) | 8 |

TABLE XLIX

V25&26-HLA-DRB1-1101-15mers-PSCA
Each peptide is a portion of SEQ ID NO: 8; each start position is specified, the length of peptide is 15 amino acids, and the end position for each peptide is the start position plus fourteen.

| Pos | 123456789012345 | score |
|---|---|---|
| 2 | MALSRTPTRQISSSD (SEQ ID NO: 6522) | 15 |
| 9 | TRQISSSDTDPPADG (SEQ ID NO: 6523) | 12 |
| 3 | ALSRTPTRQISSSDT (SEQ ID NO: 6524) | 8 |
| 13 | SSSDTDPPADGPSNP (SEQ ID NO: 6525) | 8 |
| 1 | PMALSRTPTRQISSS (SEQ ID NO: 6526) | 7 |

TABLE L

Protein Characteristics of PSCA v.4

| | Bioinformatic Program | URL | Outcome |
|---|---|---|---|
| PSCA v.4 | | | |
| ORF | ORF finder | | 570 bp |
| Protein length | | | 189 aa |
| Transmembrane region | TM Pred | http://www.ch.embnet.org/ | no TM |
| | HMMTop | http://www.enzim.hu/hmmtop/ | no TM |
| | Sosui | http://www.genome.ad.jp/SOSui/ | soluble |
| | TMHMM | http://www.cbs.dtu.dk/services/TMHMM | no TM |
| Signal Peptide | Signal P | http://www.cbs.dtu.dk/services/SignalP/ | none |
| pI | pI/MW tool | http://www.expasy.ch/tools/ | pI 8.87 |
| Molecular weight | pI/MW tool | http://www.expasy.ch/tools/ | 20.3 kDa |
| Localization | PSORT | http://psort.nibb.ac.jp/ | 90% mitochondria |
| | PSORT II | http://psort.nibb.ac.jp/ | 78% mitochondria |
| Motifs | Pfam | http://www.sanger.ac.uk/Pfam/ | no motif |
| | Prints | http://www.biochem.ucl.ac.uk/ | cadherin signature |
| | Blocks | http://www.blocks.fhcrc.org/ | Granulin |
| PSCA v.1 | | | |
| ORF | ORF finder | | 372 bp |
| Protein length | | | 123 aa |
| Transmembrane region | TM Pred | http://www.ch.embnet.org/ | 1 TM, aa 99-118 |
| | HMMTop | http://www.enzim.hu/hmmtop/ | 1 TM, aa 103-121 |
| | Sosui | http://www.genome.ad.jp/SOSui/ | membrane protein aa 100-122 |
| | TMHMM | http://www.cbs.dtu.dk/services/TMHMM | no TM |
| Signal Peptide | Signal P | http://www.cbs.dtu.dk/services/SignalP/ | yes, aa 1-15 |
| pI | pI/MW tool | http://www.expasy.ch/tools/ | pI 5.01 |
| Molecular weight | pI/MW tool | http://www.expasy.ch/tools/ | 12.9 kDa |
| Localization | PSORT | http://psort.nibb.ac.jp/ | 91% plasma membrane |
| | PSORT II | http://psort.nibb.ac.jp/ | 34% plasma membrane, 34% extracellular |
| Motifs | Pfam | http://www.sanger.ac.uk/Pfam/ | uPAR, Ly-6 |
| | Prints | http://www.biochem.ucl.ac.uk/ | no motif |
| | Blocks | http://www.blocks.fhcrc.org/ | Ly-6 |

TABLE LI

Exon boundaries of transcript PSCA v.1

| Exon Number | Start | End | Length |
|---|---|---|---|
| 1 | 10 | 69 | 60 |
| 2 | 70 | 177 | 108 |
| 3 | 178 | 985 | 808 |

TABLE LII(a)

Nucleotide sequence of transcript variant PSCA v.2 (SEQ ID NO:6527

```
tttgaggcca tataaagtca cctgaggccc tctccaccac agcccaccag tgaccatgaa   60
ggctgtgctg cttgccctgt tgatggcagg cttggccctg cagccaggca ctgccctgct  120
gtgctactcc tgcaaagccc aggtgagcaa cgaggactgc ctgcaggtgg agaactgcac  180
ccagctgggg gagcagtgct ggaccgcgcg catccgcgca gttggcctcc tgaccgtcat  240
cagcaaaggc tgcagcttga actgcgtgga tgactcacag gactactacg tgggcaagaa  300
gaacatcacg tgctgtgaca ccgacttgtg caacgccagc ggggcccatg ccctgcagcc  360
ggctgccgcc atccttgcgc tgctccctgc actcggcctg ctgctctggg acccggcca   420
gctataggct ctgggggcc  cgctgcagc  ccacactggg tgtggtgccc caggcctctg  480
tgccactcct cacacacccg gcccagtggg agcctgtcct ggttcctgag gcacatccta  540
acgcaagtct gaccatgtat gtctgcgccc ctgtccccca ccctgaccct cccatggccc  600
tctccaggac tcccacccgg cagatcggct ctattgacac agatccgcct gcagatggcc  660
cctccaaccc tctctgctgc tgtttccatg gcccagcatt ctccaccctt aaccctgtgc  720
tcaggcacct cttcccccag gaagccttcc ctgcccaccc catctatgac ttgagccagg  780
tctggtccgt ggtgtccccc gcacccagca ggggacaggc actcaggagg cccggtaaa   840
ggctgagatg aagtggactg agtagaactg gaggacagga gtcgacgtga gttcctggga  900
gtctccagag atggggcctg gaggcctgga ggaaggggcc aggcctcaca ttcgtggggc  960
tccctgaatg gcagcctcag cacagcgtag gcccttaata aacacctgtt ggataagcca 1020
```

TABLE LIII(a)

**Nucleotide sequence alignment of PSCA v.2
(SEQ ID NO:6528) and PSCA v.1 (SEQ ID NO:6529)**

```
v.2   16 agtcacctgaggccctctccaccacagcccaccagtgaccatgaaggctg   65
         ||..|   ||||                    ||||||||||||||||||
v.1    1 aggga---gagg--------------------cagtgaccatgaaggctg   27 v.2   66 tgctgcttgccctgttgatggcaggcttggccctgcagccaggcactgcc  115
         ||||||||||||||||||||||||||||||||||||||||||||||||||
v.1   28 tgctgcttgccctgttgatggcaggcttggccctgcagccaggcactgcc   77 v.2  116 ctgctgtgctactcctgcaaagcccaggtgagcaacgaggactgcctgca  165
         ||||||||||||||||||||||||||||||||||||||||||||||||||
v.1   78 ctgctgtgctactcctgcaaagcccaggtgagcaacgaggactgcctgca  127 v.2  166 ggtggagaactgcacccagctgggggagcagtgctggaccgcgcgcatcc  215
         ||||||||||||||||||||||||||||||||||||||||||||||||||
v.1  128 ggtggagaactgcacccagctgggggagcagtgctggaccgcgcgcatcc  177 v.2  216 gcgcagttggcctcctgaccgtcatcagcaaaggctgcagcttgaactgc  265
         ||||||||||||||||||||||||||||||||||||||||||||||||||
v.1  178 gcgcagttggcctcctgaccgtcatcagcaaaggctgcagcttgaactgc  227
```

TABLE LIII(a)-continued

Nucleotide sequence alignment of PSCA v.2
(SEQ ID NO:6528) and PSCA v.1 (SEQ ID NO:6529)

```
v.2   266  gtggatgactcacaggactactacgtgggcaagaagaacatgacgtgctg  315
           ||||||||||||||||||||||||||||||||||||||||||||||||||
v.1   228  gtggatgactcacaggactactacgtgggcaagaagaacatgacgtgctg  277 v.2   316  gtggatgactcacaggactactacgtgggcaagaagaacatcacgtgctg  365
           ||||||||||||||||||||||||||||||||||||||||||||||||||
v.1   278  gtggatgactcacaggactactacgtgggcaagaagaacatcacgtgctg  327 v.2   366  ccgccatccttgcgctgctccctgcactcggcctgctgctctggggaccc  415
           ||||||||||||||||||||||||||||||||||||||||||||||||||
v.1   328  ccgccatccttgcgctgctccctgcactcggcctgctgctctggggaccc  377 v.2   416  ggccagctataggctctgggggccccgctgcagcccacactgggtgtgg   465
           ||||||||||||||||||||||||||||||||||||||||||||||||
v.1   378  ggccagctataggctctgggggccccgctgcagcccacactgggtgtgg   427 v.2   466  tgcccaggcctctgtgccactcctcaca-cacccggcccagtgggagcc   514
           ||||||||||||.||||||||||||||| .|||.||||||||||||||
v.1   428  tgcccaggcctttgtgccactcctcacagaacctggcccagtgggagcc   477 v.2   515  tgtcctggttcctgaggcacatcctaacgcaagtctgaccatgtatgtct  564
           |||||||||||||||||||||||||||||||||||.|||||||||||.|
v.1   478  tgtcctggttcctgaggcacatcctaacgcaagtttgaccatgtatgttt  527 v.2   565  gcgcccctgtccccc--accctgaccctcccat-ggccctctccaggact  611
           ||.|||||.|.||||   ||||||||.|||||| ||||.|.|||||||.|
v.1   528  gcaccccttttcccnaaccctgaccttcccatgggccttttccaggatt   577 v.2   612  cccacccggcagatcggctctattgacacagatccgcctgcagatggccc  661
           ||||||||||||||.|.|.||.||||||||||||||||||||||||||||
v.1   578  cccacccggcagatcagttttagtgacacagatccgcctgcagatggccc  627 v.2   662  ctccaaccctctctgctgctgtttccatggcccagcattctccaccctta  711
           ||||||||||.||||.||||||||||||||||||||||||.|||||||||
v.1   628  ctccaaccctttctgttgctgtttccatggcccagcattttccaccctta  677 v.2   712  accctgtgctcaggcacctcttcccccaggaagccttccctgcccacccc  761
           |||||||.||||||.||||||||||||||||||||||||||.||||||||
v.1   678  accctgtgttcaggcacttcttcccccaggaagccttccctgcccacccc  727 v.2   762  atctatgacttgagccaggtctggtccgtggtgtccccgcacccagcag   811
           ||.|||||.|||||||||||.|||||||||||||||||||||||||||
v.1   728  atttatgaattgagccaggtttggtccgtggtgtccccgcacccagcag   777 v.2   812  gggacaggcactcaggagggcccggtaaaggctgagatgaagtggactga  861
           |||||||||.||||||||||||.|||||||||||||||||||||||||||
v.1   778  gggacaggcaatcaggagggcccagtaaaggctgagatgaagtggactga  827 v.2   862  gtagaactggaggacaggagtcgacgtgagttcctgggagtctccagaga  911
           |||||||||||||||.||.|||.|||||||||||||||||.|||||||||
v.1   828  gtagaactggaggacaagagttgacgtgagttcctgggagtttccagaga  877 v.2   912  tggggcctggaggcctggaggaaggggccaggcctcacattcgtggggct  961
           ||||||||||||||||||||||||||||||||||||||||||.|||||||
v.1   878  tggggcctggaggcctggaggaaggggccaggcctcacatttgtggggct  927 v.2   962  ccctgaatggcagcctcagcacagcgtaggcccttaataaacacctgttg  1011
           |||. |||||||||||||.|||||||||||||||||||||||||||||||
v.1   928  ccc-gaatggcagcctgagcacagcgtaggcccttaataaacacctgttg  976 v.2   1012 gataagcca                                           1020
           |||||||||
v.1   977  gataagcca                                           985
```

TABLE LIV(a)

Peptide sequences of protein coded by PSCA v.2 (SEQ ID NO:6530)

| | | | | | |
|---|---|---|---|---|---|
| MKAVLLALLM | AGLALQPGTA | LLCYSCKAQV | SNEDCLQVEN | CTQLGEQCWT | ARIRAVGLLT | 60 |
| VISKGCSLNC | VDDSQDYYVG | KKNTTCCDTD | LCNASGAHAL | QPAAAILALL | PALGLLLWGP | 120 |
| GQL | | | | | |

TABLE LV(a)

Amino acid sequence alignment of PSCA v.2
(SEQ ID NO:6531) and PSCA v.1 (SEQ ID NO:6532)

```
v.2    1  MKAVLLALLMAGLALQPGTALLCYSCKAQVSNEDCLQVENCTQLGEQCWT   50
          ||||||||||||||||||||||||||||||||||||||||||||||||||
v.1    1  MKAVLLALLMAGLALQPGTALLCYSCKAQVSNEDCLQVENCTQLGEQCWT   50 v.2   51  ARIRAVGLLTVISKGCSLNCVDDSQDYYVGKKNITCCDTDLCNASGAHAL  100
          |||||||||||||||||||||||||||||||||||||||||||||||||
v.1   51  ARIRAVGLLTVISKGCSLNCVDDSQDYYVGKKNITCCDTDLCNASGAHAL  100 v.2  101  QPAAAILALLPALGLLLWGPGQL                             123
          |||||||||||||||||||||||
v.1  101  QPAAAILALLPALGLLLWGPGQL                             123
```

TABLE LII(b)

Nucleotide sequence of transcript variant PSCA v.3 (SEQ ID NO:6533)

| | | | | | |
|---|---|---|---|---|---|
| tttgaggcca | tataaagtca | cctgaggccc | tctccaccac | agcccaccag | tgaccatgaa | 60 |
| ggctgtgctg | cttgccctgt | tgatggcagg | cttggccctg | cagccaggca | ctgccctgct | 120 |
| gtgctactcc | tgcaaagccc | aggcgcagtt | ggcctcctga | ccgtcatcag | caaaggctgc | 180 |
| agcttgaact | gcgtggatga | ctcacaggac | tactacgtgg | gcaagaagaa | catcacgtgc | 240 |
| tgtgacaccg | acttgtgcac | tcggcctgct | gctctgggga | cccggccagc | tataggctct | 300 |
| gggggggcccc | gctgcagccc | acactgggtg | tggtgcccca | ggcctctgtg | ccactcctca | 360 |
| cacccggc | ccagtgggag | cctgtcctgg | ttcctgaggc | acatcctaac | gcaagtctga | 420 |
| ccatgtatgt | ctgcgcccct | gtcccccacc | ctgaccctcc | catggccctc | tccaggactc | 480 |
| ccacccggca | gatcggctct | attgacacag | atccgcctgc | agatggcccc | tccaaccctc | 540 |
| tctgctgctg | tttccatggc | ccagcattct | ccacccttaa | ccctgtgctc | aggcacctct | 600 |
| tcccccagga | agccttccct | gcccacccca | tctatgactt | gagccaggtc | tggtccgtgg | 660 |
| tgtcccccgc | acccagcagg | ggacaggcac | tcaggagggc | ccggtaaagg | ctgagatgaa | 720 |
| gtggactgag | tagaactgga | ggacaggagt | cgacgtgagt | tcctgggagt | ctccagagat | 780 |
| ggggcctgga | ggcctggagg | aaggggccag | gcctcacatt | cgtggggctc | cctgaatggc | 840 |
| agcctcagca | cagcgtaggc | ccttaataaa | cacctgttgg | ataagcca | | 888 |

TABLE LIII(b)

Nucleotide sequence alignment of PSCA v.2
(SEQ ID NO:6534) and PSCA v.3 (SEQ ID NO:6535)

```
v.2    1  tttgaggccatataaagtcacctgaggccctctccaccacagcccaccag   50
          ||||||||||||||||||||||||||||||||||||||||||||||||||
v.3    1  tttgaggcatataaagtcacctgaggccctctccaccacagcccaccag    50 v.2   51  tgaccatgaaggctgtgctgcttgccctgttgatggcaggcttggccctg  100
          ||||||||||||||||||||||||||||||||||||||||||||||||||
v.3   51  tgaccatgaaggctgtgctgcttgccctgttgatggcaggcttggccctg  100
```

TABLE LIII(b)-continued

Nucleotide sequence alignment of PSCA v.2
(SEQ ID NO:6534) and PSCA v.3 (SEQ ID NO:6535)

```
v.2   101  cagccaggcactgccctgctgtgctactcctgcaaagcccaggtgagcaa   150
           ||||||||||||||||||||||||||||||||||||||||
v.3   101  cagccaggcactgccctgctgtgctactcctgcaaagcccag--------  142 v.2   151  cgaggactgcctgcaggtggagaactgcacccagctgggggagcagtgct  200
v.3   143  --------------------------------------------------  142 v.2   201  ggaccgcgcgcatccgcgcagttggcctcctgaccgtcatcagcaaaggc  250
                          ||||||||||||||||||||||||||||||||||||
v.3   143  ---------------gcgcagttggcctcctgaccgtcatcagcaaaggc  177 v.2   251  tgcagcttgaactgcgtggatgactcacaggactactacgtgggcaagaa  300
           ||||||||||||||||||||||||||||||||||||||||||||||||||
v.3   178  tgcagcttgaactgcgtggatgactcacaggactactacgtgggcaagaa  227 v.2   866  aactggaggacaggagtcgacgtgagttcctgggagtctccagagatggg  915
           ||||||||||||||||||||||||||||||||||||||||||||||||||
v.4  1020  aactggaggacaggagtcgacgtgagttcctgggagtctccagagatggg 1069 v.2   301  gaacatcacgtgctgtgacaccgacttgtgcaacgccagcggggcccatg  350
           |||||||||||||||||||||||||||||
v.3   228  gaacatcacgtgctgtgacaccgacttg----------------------  255 v.2   351  ccctgcagccggctgccgccatccttgcgctgctccctgcactcggcctg  400
                                                 ||||||||||||||
v.3   256  -------------------------------------tgcactcggcctg  268 v.2   401  ctgctctggggacccggccagctataggctctgggggggccccgctgcagc  450
           ||||||||||||||||||||||||||||||||||||||||||||||||||
v.3   269  ctgctctggggacccggccagctataggctctgggggggccccgctgcagc  318 v.2   451  ccacactgggtgtggtgccccaggcctctgtgccactcctcacacacccg  500
           ||||||||||||||||||||||||||||||||||||||||||||||||||
v.3   319  ccacactgggtgtggtgccccaggcctctgtgccactcctcacacacccg  368 v.2   501  gcccagtgggagcctgtcctggttcctgaggcacatcctaacgcaagtct  550
           ||||||||||||||||||||||||||||||||||||||||||||||||||
v.3   369  gcccagtgggagcctgtcctggttcctgaggcacatcctaacgcaagtct  418 v.2   551  gaccatgtatgtctgcgccctgtcccccaccctgaccctcccatggccc   600
           ||||||||||||||||||||||||||||||||||||||||||||||||||
v.3   419  gaccatgtatgtctgcgccctgtcccccaccctgaccctcccatggccc   468 v.2   601  tctccaggactcccacccggcagatcggctctattgacacagatccgcct  650
           ||||||||||||||||||||||||||||||||||||||||||||||||||
v.3   469  tctccaggactcccacccggcagatcggctctattgacacagatccgcct  518 v.2   651  gcagatggcccctccaaccctctctgctgctgtttccatggcccagcatt  700
           ||||||||||||||||||||||||||||||||||||||||||||||||||
v.3   519  gcagatggcccctccaaccctctctgctgctgtttccatggcccagcatt  568 v.2   701  ctccacccttaaccctgtgctcaggcacctcttcccccaggaagccttcc  750
           ||||||||||||||||||||||||||||||||||||||||||||||||||
v.3   569  ctccacccttaaccctgtgctcaggcacctcttcccccaggaagccttcc  618 v.2   751  ctgcccaccccatctatgacttgagccaggtctggtccgtggtgtccccc  800
           ||||||||||||||||||||||||||||||||||||||||||||||||||
v.3   619  ctgcccaccccatctatgacttgagccaggtctggtccgtggtgtccccc  668 v.2   801  gcacccagcaggggacaggcactcaggagggcccggtaaaggctgagatg  850
           ||||||||||||||||||||||||||||||||||||||||||||||||||
v.3   669  gcacccagcaggggacaggcactcaggagggcccggtaaaggctgagatg  718 v.2   851  aagtggactgagtagaactggaggacaggagtcgacgtgagttcctggga  900
           ||||||||||||||||||||||||||||||||||||||||||||||||||
v.3   719  aagtggactgagtagaactggaggacaggagtcgacgtgagttcctggga  768 v.2   901  gtctccagagatggggcctggaggcctggaggaaggggccaggcctcaca  950
           ||||||||||||||||||||||||||||||||||||||||||||||||||
v.3   769  gtctccagagatggggcctggaggcctggaggaaggggccaggcctcaca  818
```

TABLE LIII(b)-continued

Nucleotide sequence alignment of PSCA v.2
(SEQ ID NO:6534) and PSCA v.3 (SEQ ID NO:6535)

```
v.2   951  ttcgtggggctccctgaatggcagcctcagcacagcgtaggcccttaata  1000
           ||||||||||||||||||||||||||||||||||||||||||||||||||
v.3   819  ttcgtggggctccctgaatggcagcctcagcacagcgtaggcccttaata   868 v.2  1001  aacacctgttggataagcca                                1020
           ||||||||||||||||||||
v.3   869  aacacctgttggataagcca                                 888
```

TABLE LIV(b)

Peptide sequences of protein coded by PSCA v.3 (SEQ ID NO:6536)

```
MYVCAPVPHP  DPPMALSRTP  TRQIGSIDTD  PPADGPSNPL  CCCFHGPAFS  TLNPVLRHLF   60
PQEAFPAHPI  YDLSQVWSVV  SPAPSRGQAL  RRAR                                94
```

TABLE LV(b)

| Amino acid sequence alignment of PSCA v.2 and PSCA v.3 | 25 |
|---|---|
| NO SIGNIFICANT HOMOLOGY | |

TABLE LII(c)

Nucleotide sequence of transcript variant PSCA v.4
(SEQ ID NO:6537)

```
gacagtgaac cctgcgctga aggcgttggg gctcctgcag ttctggggca gccacaggcg   60
cccaggtttt cgtgccgatc agcccaggac ggtcttcccg gtgcagtttc tgatgcgggg  120
agggcagtgc tgccttccgg tcaccaggac cagtgctcag cccgcctgct tgacccccct  180
acttagctgg ggtccaatcc atacccaatt tagatgattc agacgatggg atttgaaact  240
tttgaactgg gtgcgactta agcactgccc tgctgtgcta ctcctgcaaa gcccaggtga  300
gcaacgagga ctgcctgcag gtggagaact gcacccagct gggggagcag tgctggaccg  360
cgcgcatccg cgcagttggc ctcctgaccg tcatcagcaa aggctgcagc ttgaactgcg  420
tggatgactc acaggactac tacgtgggca agaagaacat cacgtgctgt gacaccgact  480
tgtgcaacgc cagcggggcc catgccctgc agccggctgc cgccatcctt gcgctgctcc  540
ctgcactcgg cctgctgctc tggggacccg gccagctata ggctctgggg gccccgctg   600
cagcccacac tgggtgtggt gccccaggcc tctgtgccac tcctcacaca cccggcccag  660
tgggagcctg tcctggttcc tgaggcacat cctaacgcaa gtctgaccat gtatgtctgc  720
gcccctgtcc cccacccga ccctccccatg gccctctcca ggactccac ccggcagatc  780
ggctctattg acacagatcc gcctgcagat ggcccctcca accctctctg ctgctgtttc  840
catggcccag cattctccac ccttaaccct gtgctcaggc acctcttccc ccaggaagcc  900
ttccctgccc accccatcta tgacttgagc caggtctggt ccgtggtgtc ccccgcaccc  960
agcaggggac aggcactcag gagggcccgg taaaggctga gatgaagtgg actgagtaga 1020
actggaggac aggagtcgac gtgagttcct gggagtctcc agagatgggg cctggaggcc 1080
tggaggaagg ggccaggcct cacattcgtg gggctccctg aatggcagcc tcagcacagc 1140
gtaggcccct aataaacacc tgttggataa gcca                              1174
```

TABLE LIII(c)

Nucleotide sequence alignment of PSCA v.2
(SEQ ID NO:6538) and PSCA v.4 (SEQ ID NO:6539)

```
v.2    1  tttgaggccatataaagtcacctgaggccctctccacca-----------  39
          |.||.|||      ||.|||   ||||.|        |||
v.4   42  tctggggc-------agccac---aggcgc------ccagggtttcgtgc  75 v.2   40  ----cagccca-----------ccagtgacca-------------tgaag  61
              |||||||           ||.|||  ||             .||.|
v.4   76  cgatcagcccaggacggtcttcccggtg--cagtttctgatgcggggagg  123 v.2   62  gctgtgctg-cttgccctgt------------tgatggcag-------gc  91
          ||.|||||| |||  ||.||            ||.| |||       ||
v.4  124  gcagtgctgcctt--ccggtcaccaggaccagtgct--cagcccgcctgc  169 v.2   92  ttggccc------------------------------------------tg  100
          |||.|||                                          |.
v.4  170  ttgaccccttacttagctggggtccaatccatacccaatttagatgatt  219 v.2  101  cagcc-----------------------------------aggcactgcc  115
          |||.|                                   .||||||||
v.4  220  cagacgatgggatttgaaacttttgaactgggtgcgacttaagcactgcc  269 v.2  116  ctgctgtgctactcctgcaaagcccaggtgagcaacgaggactgcctgca  165
          ||||||||||||||||||||||||||||||||||||||||||||||||||
v.4  270  ctgctgtgctactcctgcaaagcccaggtgagcaacgaggactgcctgca  319 v.2  166  ggtggagaactgcacccagctgggggagcagtgctggaccgcgcgcatcc  215
          ||||||||||||||||||||||||||||||||||||||||||||||||||
v.4  320  ggtggagaactgcacccagctgggggagcagtgctggaccgcgcgcatcc  369 v.2  216  gcgcagttggcctcctgaccgtcatcagcaaaggctgcagcttgaactgc  265
          ||||||||||||||||||||||||||||||||||||||||||||||||||
v.4  370  gcgcagttggcctcctgaccgtcatcagcaaaggctgcagcttgaactgc  419 v.2  266  gtggatgactcacaggactactacgtgggcaagaagaacatcacgtgctg  315
          ||||||||||||||||||||||||||||||||||||||||||||||||||
v.4  420  gtggatgactcacaggactactacgtgggcaagaagaacatcacgtgctg  469 v.2  316  tgacaccgacttgtgcaacgccagcggggcccatgccctgcagccggctg  365
          ||||||||||||||||||||||||||||||||||||||||||||||||||
v.4  470  tgacaccgacttgtgcaacgccagcggggcccatgccctgcagccggctg  519 v.2  366  ccgccatccttgcgctgctccctgcactcggcctgctgctctggggaccc  415
          ||||||||||||||||||||||||||||||||||||||||||||||||||
v.4  520  ccgccatccttgcgctgctccctgcactcggcctgctgctctggggaccc  569 v.2  416  ggccagctataggctctggggggccccgctgcagcccacactgggtgtgg  465
          ||||||||||||||||||||||||||||||||||||||||||||||||||
v.4  570  ggccagctataggctctggggggccccgctgcagcccacactgggtgtgg  619 v.2  466  tgccccaggcctctgtgccactcctcacacacccggcccagtgggagcct  515
          ||||||||||||||||||||||||||||||||||||||||||||||||||
v.4  620  tgccccaggcctctgtgccactcctcacacacccggcccagtgggagcct  669 v.2  516  gtcctggttcctgaggcacatcctaacgcaagtctgaccatgtatgtctg  565
          ||||||||||||||||||||||||||||||||||||||||||||||||||
v.4  670  gtcctggttcctgaggcacatcctaacgcaagtctgaccatgtatgtctg  719 v.2  566  cgcccctgtcccccaccctgaccctcccatggccctctccaggactccca  615
          ||||||||||||||||||||||||||||||||||||||||||||||||||
v.4  720  cgcccctgtcccccaccctgaccctcccatggccctctccaggactccca  769 v.2  616  cccggcagatcggctctattgacacagatccgcctgcagatggcccctcc  665
          ||||||||||||||||||||||||||||||||||||||||||||||||||
v.4  770  cccggcagatcggctctattgacacagatccgcctgcagatggcccctcc  819 v.2  666  aaccctctctgctgctgtttccatggcccagcattctccacccttaaccc  715
          ||||||||||||||||||||||||||||||||||||||||||||||||||
v.4  820  aaccctctctgctgctgtttccatggcccagcattctccacccttaaccc  869 v.2  716  tgtgctcaggcacctcttcccccaggaagccttccctgcccacccatct  765
          |||||||||||||||||||||||||||||||||||||||||||||||||
v.4  870  tgtgctcaggcacctcttcccccaggaagccttccctgcccacccatct  919 v.2  766  atgacttgagccaggtctggtccgtggtgtccccgcacccagcaggga  815
          ||||||||||||||||||||||||||||||||||||||||||||||||
v.4  920  atgacttgagccaggtctggtccgtggtgtccccgcacccagcaggga  969
```

TABLE LIII(c)-continued

Nucleotide sequence alignment of PSCA v.2 (SEQ ID NO:6538) and PSCA v.4 (SEQ ID NO:6539)

```
v.2    816  caggcactcaggagggcccggtaaaggctgagatgaagtggactgagtag   865
            ||||||||||||||||||||||||||||||||||||||||||||||||||
v.4    970  caggcactcaggagggcccggtaaaggctgagatgaagtggactgagtag  1019 v.2    866  aactggaggacaggagtcgacgtgagttcctgggagtctccagagatggg   915
            ||||||||||||||||||||||||||||||||||||||||||||||||||
v.4   1020  aactggaggacaggagtcgacgtgagttcctgggagtctccagagatggg  1069 v.2    916  gcctggaggcctggaggaaggggccaggcctcacattcgtgggctccct    965
            ||||||||||||||||||||||||||||||||||||||||||||||||||
v.4   1070  gcctggaggcctggaggaaggggccaggcctcacattcgtgggctccct   1119 v.2    966  gaatggcagcctcagcacagcgtaggcccttaataaacacctgttggata  1015
            ||||||||||||||||||||||||||||||||||||||||||||||||||
v.4   1120  gaatggcagcctcagcacagcgtaggcccttaataaacacctgttggata  1169 v.2   1016  agcca                                               1020
            |||||
v.4   1170  agcca                                               1174
```

TABLE LIV(c)

Peptide sequences of protein coded by PSCA v.4 (SEQ ID NO:6540)

| | | | | | |
|---|---|---|---|---|---|
| MTHRTTTWAR | RTSRAVTPTC | ATPAGPMPCS | RLPPSLRCSL | HSACCSGDPA | SYRLWGAPLQ   60 |
| PTLGVVPQAS | VPLLTHPAQW | EPVLVPEAHP | NASLTMYVCA | PVPHPDPPMA | LSRTPTRQIG  120 |
| SIDTDPPADG | PSNPLCCCFH | GPAFSTLNPV | LRHLFPQEAF | PAHPIYDLSQ | VWSVVSPAPS  180 |
| RGQALRRAR | | | | | |

TABLE LV(c)

Amino acid sequence alignment of PSCA v.2 and PSCA v.4

NO SIGNIFICANT HOMOLOGY

TABLE LII(d)

Nucleotide sequence of transcript variant PSCA v.5 (SEQ ID NO:6541)

| | | | | | |
|---|---|---|---|---|---|
| gacagtgaac | cctgcgctga | aggcgttggg | gctcctgcag | ttctggggca | gccacaggcg   60 |
| cccagggttt | cgtgccgatc | agcccaggac | ggtcttcccg | gtgcagtttc | tgatgcgggg  120 |
| agggcagtgc | tgccttccgg | tcaccaggac | cagtgctcag | cccgcctgct | tgaccccctt  180 |
| acttagctgg | ggtccaatcc | atacccaatt | tagatgattc | agacgatggg | atttgaaact  240 |
| tttgaactgg | gtgcgactta | agcactgccc | tgctgtgcta | ctcctgcaaa | gcccaggtga  300 |
| gcaacgagga | ctgcctgcag | gtggagaact | gcacccagct | gggggagcag | tgctggaccg  360 |
| cgcgcatccg | tgagtggggg | gacgacagcc | gccaggccta | ggtctctgcc | actgaactat  420 |
| taatctttct | ggccatctgt | ccgcatctgt | gtgctgtttt | ccttccacct | gtccccgacc  480 |
| cgtcccgcac | ctgcacccccc | aacaatcacc | cagcatctgt | ccctccagcc | atcctcctcc  540 |
| atctgccact | cctccactca | tctgtccctc | cccatcctcc | atcttccact | cctccaccca  600 |
| tctgtccctc | cccatccctg | agctcactta | ctcactcacc | ccatttctga | cgctcagcgg  660 |
| gtggtccatc | tgcctcggac | atctggatag | ggctgagacc | agggccgaga | ccaggccctc  720 |

TABLE LII(d)-continued

Nucleotide sequence of transcript variant PSCA v.5 (SEQ ID NO:6541)

| | | | | | |
|---|---|---|---|---|---|
| gcactgcttg | caatcctgag | gccagcccag | ggggactcta | gagcattagg | cagggtggga | 780 |
| caggaggagg | cctggggcag | gtcaggcagg | tgagcacaca | gggcagcccc | atccccggat | 840 |
| cccgctgctc | cccaggcgca | gttggcctcc | tgaccgtcat | cagcaaaggc | tgcagcttga | 900 |
| actgcgtgga | tgactcacag | gactactacg | tgggcaagaa | gaacatcacg | tgctgtgaca | 960 |
| ccgacttgtg | caacgccagc | ggggcccatg | ccctgcagcc | ggctgccgcc | atccttgcgc | 1020 |
| tgctccctgc | actcggcctg | ctgctctggg | gacccggcca | gctataggct | ctgggggggcc | 1080 |
| ccgctgcagc | ccacactggg | tgtggtgccc | caggcctctg | tgccactcct | cacacacccg | 1140 |
| gcccagtggg | agcctgtcct | ggttcctgag | gcacatccta | acgcaagtct | gaccatgtat | 1200 |
| gtctgcgccc | ctgtccccca | ccctgaccct | cccatggccc | tctccaggac | tcccacccgg | 1260 |
| cagatcggct | ctattgacac | agatccgcct | gcagatggcc | cctccaaccc | tctctgctgc | 1320 |
| tgtttccatg | gcccagcatt | ctccaccctt | aaccctgtgc | tcaggcacct | cttcccccag | 1380 |
| gaagccttcc | ctgcccaccc | catctatgac | ttgagccagg | tctggtccgt | ggtgtccccc | 1440 |
| gcacccagca | ggggacaggc | actcaggagg | gcccggtaaa | ggctgagatg | aagtggactg | 1500 |
| agtagaactg | gaggacagga | gtcgacgtga | gttcctggga | gtctccagag | atggggcctg | 1560 |
| gaggcctgga | ggaaggggcc | aggcctcaca | ttcgtggggc | tccctgaatg | gcagcctcag | 1620 |
| cacagcgtag | gcccttaata | aacacctgtt | ggataagcca | | | 1660 |

TABLE LIII(d)

Nucleotide sequence alignment of PSCA v.2
(SEQ ID NO:6542 and PSCA v.5 (SEQ ID NO:6543)

```
v.2    1 tttgaggccatataaagtcacctgaggccctctccacca-----------  39
         |.||.|||     ||.|||   ||||.|       |||
v.5   42 tctggggc-------agccac---aggcgc------ccagggtttcgtgc  75 v.2   40 ----cagccca-----------ccagtgacca-------------tgaag  61
             |||||||           ||.|||  ||              .||.|
v.5   76 cgatcagcccaggacggtcttcccggtg--cagtttctgatgcggggagg  123 v.2   62 gctgtgctg-cttgccctgt-----------tgatggcag-------gc  91
         ||.||||||  |||   ||.||           ||.|  |||       ||
v.5  124 gcagtgctgcctt--ccggtcaccaggaccagtgct--cagcccgcctgc  169 v.2   92 ttggccc----------------------------------------тg  100
         |||.|||                                          |.
v.5  170 ttgacccccttacttagctggggtccaatccatacccaatttagatgatt  219 v.2  101 cagcc-----------------------------------aggcactgcc  115
         |||.|                                   |.||||||||
v.5  170 cagacgatgggatttgaaacttttgaactgggtgctgcttaagcactgcc  219 v.2  116 ctgctgtgctactcctgcaaagcccaggtgagcaacgaggactgcctgca  165
         ||||||||||||||||||||||||||||||||||||||||||||||||||
v.5  270 ctgctgtgctactcctgcaaagcccaggtgagcaacgaggactgcctgca  319 v.2  166 ggtggagaactgcacccagctgggggagcagtgctggaccgcgcgcatcc  215
         ||||||||||||||||||||||||||||||||||||||||||||||||||
v.5  320 ggtggagaactgcacccagctgggggagcagtgctggaccgcgcgcatcc  369 v.2  216 --------------------------------------------------  215 v.5  370 gtgagtggggggacgacagccgccaggcctaggtctctgccactgaacta  419 v.2  216 --------------------------------------------------  215 v.5  420 ttaatctttctggccatctgtccgcatctgtgtgctgttttccttccacc  469
```

TABLE LIII(d)-continued

Nucleotide sequence alignment of PSCA v.2
(SEQ ID NO:6542 and PSCA v.5 (SEQ ID NO:6543)

```
v.2   216  ------------------------------------------------    215 v.5   470  tgtccccgacccgtcccgcacctgcaccccaacaatcacccagcatctg   519 v.2   216  ------------------------------------------------    215 v.5   520  tccctccagccatcctcctccatctgccactcctccactcatctgtccct   569 v.2   216  ------------------------------------------------    215 v.5   570  ccccatcctccatcttccactcctccacccatctgtccctccccatccct   619 v.2   216  ------------------------------------------------    215 v.5   620  gagctcacttactcactcaccccatttctgacgctcagcgggtggtccat   669 v.2   216  ------------------------------------------------    215 v.5   670  ctgcctcggacatctggatagggctgagaccagggccgagaccaggccct   719 v.2   216  ------------------------------------------------    215 v.5   720  cgcactgcttgcaatcctgaggccagcccaggggactctagagcattag   769 v.2   216  ------------------------------------------------    215 v.5   770  gcagggtgggacaggaggaggcctggggcaggtcaggcaggtgagcacac   819 v.2   216  -----------------------------------gcgcagttggcctc   229
                                              ||||||||||||||
v.5   820  agggcagccccatccccggatcccgctgctcccaggcgcagttggcctc   869 v.2   230  ctgaccgtcatcagcaaaggctgcagcttgaactgcgtggatgactcaca   279
           ||||||||||||||||||||||||||||||||||||||||||||||||||
v.5   870  ctgaccgtcatcagcaaaggctgcagcttgaactgcgtggatgactcaca   919 v.2   280  ggactactacgtgggcaagaagaacatcacgtgctgtgacaccgacttgt   329
           ||||||||||||||||||||||||||||||||||||||||||||||||||
v.5   920  ggactactacgtgggcaagaagaacatcacgtgctgtgacaccgacttgt   969 v.2   330  gcaacgccagcggggcccatgccctgcagccggctgccgccatccttgcg   379
           ||||||||||||||||||||||||||||||||||||||||||||||||||
v.5   970  gcaacgccagcggggcccatgccctgcagccggctgccgccatccttgcg  1019 v.2   380  ctgctccctgcactcggcctgctgctctggggacccggccagctataggc   429
           ||||||||||||||||||||||||||||||||||||||||||||||||||
v.5  1020  ctgctccctgcactcggcctgctgctctggggacccggccagctataggc  1069 v.2   430  tctgggggcccgctgcagcccacactgggtgtggtgccccaggcctct    479
           ||||||||||||||||||||||||||||||||||||||||||||||||||
v.5  1070  tctgggggcccgctgcagcccacactgggtgtggtgccccaggcctct   1119 v.2   480  gtgccactcctcacacacccggcccagtgggagcctgtcctggttcctga   529
           ||||||||||||||||||||||||||||||||||||||||||||||||||
v.5  1120  gtgccactcctcacacacccggcccagtgggagcctgtcctggttcctga  1169 v.2   530  ggcacatcctaacgcaagtctgaccatgtatgtctgcgccctgtcccc    579
           ||||||||||||||||||||||||||||||||||||||||||||||||||
v.5  1170  ggcacatcctaacgcaagtctgaccatgtatgtctgcgccctgtcccc   1219 v.2   580  accctgaccctcccatggccctctccaggactcccaccggcagatcggc    629
           ||||||||||||||||||||||||||||||||||||||||||||||||||
v.5  1220  accctgaccctcccatggccctctccaggactcccaccggcagatcggc   1269 v.2   630  tctattgacacagatccgcctgcagatggcccctccaaccctctctgctg   679
           ||||||||||||||||||||||||||||||||||||||||||||||||||
v.5  1270  tctattgacacagatccgcctgcagatggcccctccaaccctctctgctg  1319 v.2   680  ctgtttccatggcccagcattctccacccttaaccctgtgctcaggcacc   729
           ||||||||||||||||||||||||||||||||||||||||||||||||||
v.5  1320  ctgtttccatggcccagcattctccacccttaaccctgtgctcaggcacc  1369 v.2   730  tcttccccaggaagccttccctgcccaccccatctatgacttgagccag   779
           ||||||||||||||||||||||||||||||||||||||||||||||||||
v.5  1370  tcttccccaggaagccttccctgcccacccatctatgacttgagccag  1419
```

TABLE LIII(d)-continued

Nucleotide sequence alignment of PSCA v.2
(SEQ ID NO:6542 and PSCA v.5 (SEQ ID NO:6543)

```
v.2   780  gtctggtccgtggtgtccccgcacccagcaggggacaggcactcaggag   829
           |||||||||||||||||||||||||||||||||||||||||||||||||
v.5  1420  gtctggtccgtggtgtccccgcacccagcaggggacaggcactcaggag  1469 v.2   830  ggcccggtaaaggctgagatgaagtggactgagtagaactggaggacagg   879
           ||||||||||||||||||||||||||||||||||||||||||||||||||
v.5  1470  ggcccggtaaaggctgagatgaagtggactgagtagaactggaggacagg  1519 v.2   880  agtcgacgtgagttcctgggagtctccagagatggggcctggaggcctgg   929
           ||||||||||||||||||||||||||||||||||||||||||||||||||
v.5  1520  agtcgacgtgagttcctgggagtctccagagatggggcctggaggcctgg  1569 v.2   930  aggaaggggccaggcctcacattcgtggggctccctgaatggcagcctca   979
           ||||||||||||||||||||||||||||||||||||||||||||||||||
v.5  1570  aggaaggggccaggcctcacattcgtggggctccctgaatggcagcctca  1629 v.2   980  gcacagcgtaggcccttaataaacacctgttggataagcca           1020
           |||||||||||||||||||||||||||||||||||||||||
v.5  1620  gcacagcgtaggcccttaataaacacctgttggataagcca           1660
```

TABLE LIV(d)

Peptide sequences of protein coded by PSCA v.5 (SEQ ID NO:6544)

| | | | | | | |
|---|---|---|---|---|---|---|
| MTHRTTTWAR | RTSRAVTPTC | ATPAGPMPCS | RLPPSLRCSL | HSACCSGDPA | SYRLWGAPLQ | 60 |
| PTLGVVPQAS | VPLLTHPAQW | EPVLVPEAHP | NASLTMYVCA | PVPHPDPPMA | LSRTPTRQIG | 120 |
| SIDTDPPADG | PSNPLCCCFH | GPAFSTLNPV | LRHLFPQEAF | PAHPIYDLSQ | VWSVVSPAPS | 180 |
| RGQALRRAR | | | | | | |

TABLE LV(d)

Amino acid sequence alignment of PSCA v.2 and PSCA v.5

NO SIGNIFICANT HOMOLOGY

TABLE LVI

SNP and codon changes in PSCA v.2 and v.4

| Variant | V.2 position | SNP | AA* change | AA position | V.4 position | AA change | AA position | Variant |
|---|---|---|---|---|---|---|---|---|
| V.6 | 57 | t/c | M/—** | 1 | Not in v.4 | | | |
| V.7 | 367 | c/t | A/A | 104 | 521 | P/L | 33 | v.19 |
| V.8 | 424 | a/c | L/L | 123 | 578 | Y/S | 52 | v.20 |
| V.9 | 495 | c/g | | | 649 | H/D | 76 | v.21 |
| V.10 | 499 | c/t | | | 653 | P/L | 77 | v.22 |
| V.11 | 563 | c/t | | | 717 | V/V | 98 | v.23 |
| V.12 | 567 | g/a | | | 721 | A/T | 100 | v.24 |
| V.13 | 627 | g/a | | | 781 | G/S | 120 | v.25 |
| V.14 | 634 | t/g | | | 788 | I/S | 122 | v.26 |
| V.15 | 835 | g/a | | | 989 | R/Q | 189 | v.27 |
| V.16 | 847 | g/a | | | 1001 | | | v.28 |
| V.17 | 878 | g/a | | | 1032 | | | v.29 |
| V.18 | 978 | c/g | | | 1132 | | | v.30 |

*AA: amino acid
**—: No amino acid encoded.

SEQUENCE LISTING (6557 sequences)

SEQ ID NO: 1 - protein, 14 aa, Homo sapiens
QYIKANSKFIGITE

SEQ ID NO: 2 - protein, 21 aa, Homo sapiens
DIEKKIAKMEKASSVFNVVNS

SEQ ID NO: 3 - protein, 16 aa, Homo sapiens
GAVDSILGGVATYGAA

SEQ ID NO: 4 - protein, 12 aa, Homo sapiens
  MOD_RES 1, 12: Xaa = D-alanine or L-alanine
  MOD_RES 3: Xaa= cyclohexylalanine, phenylalanine, or tyrosine
XKXVAAWTLKAX

SEQ ID NO: 5 - protein, 6 aa, Homo sapiens
TILVMS

SEQ ID NO: 6 - protein, 7 aa, Homo sapiens
LIVMATQ

SEQ ID NO: 7 - protein, 7 aa, Homo sapiens
VSMATLI

SEQ ID NO: 8 - protein, 8 aa, Homo sapiens
YFWIVLMT

SEQ ID NO: 9 - protein, 6 aa, Homo sapiens
QLIVMP

SEQ ID NO: 10 - protein, 7 aa, Homo sapiens
LMVQIAT

SEQ ID NO: 11 - protein, 11 aa, Homo sapiens
LMVISATFCGD

SEQ ID NO: 12 - protein, 12 aa, Homo sapiens
VTMLISAGNCDF

SEQ ID NO: 13 - protein, 4 aa, Homo sapiens
YFWM

SEQ ID NO: 14 - protein, 7 aa, Homo sapiens
MVTALIS

SEQ ID NO: 15 - protein, 8 aa, Homo sapiens
MVALFIST

SEQ ID NO: 16 - protein, 7 aa, Homo sapiens
AVTMSLI

SEQ ID NO: 17 - protein, 4 aa, Homo sapiens
DEAS

SEQ ID NO: 18 - protein, 6 aa, Homo sapiens
IVMATL

SEQ ID NO: 19 - protein, 6 aa, Homo sapiens
FIYWLM

SEQ ID NO: 20 - protein, 8 aa, Homo sapiens
VILFMWYA

SEQ ID NO: 21 - protein, 8 aa, Homo sapiens
FYLWMIVA

SEQ ID NO: 22 - protein, 8 aa, Homo sapiens
FWYLIMVA

SEQ ID NO: 23 - protein, 8 aa, Homo sapiens
FWYLIVMA

SEQ ID NO: 24 - protein, 8 aa, Homo sapiens
FWYMIVLA

SEQ ID NO: 25 - protein, 6 aa, Homo sapiens
VLIMAT

SEQ ID NO: 26 - protein, 6 aa, Homo sapiens
KYRHFA

SEQ ID NO: 27 - protein, 4 aa, Homo sapiens
KRYH

SEQ ID NO: 28 - protein, 4 aa, Homo sapiens
FLIW

SEQ ID NO: 29 - protein, 8 aa, Homo sapiens
LMFWYAIV

SEQ ID NO: 30 - protein, 8 aa, Homo sapiens
LMFWYIVA

SEQ ID NO: 31 - protein, 8 aa, Homo sapiens
LIVFWYAM

SEQ ID NO: 32 - protein, 8 aa, Homo sapiens
IMFWYALV

SEQ ID NO: 33 - protein, 9 aa, Homo sapiens
ATIVLMFWY

SEQ ID NO: 34 - protein, 7 aa, Homo sapiens
FMYLIVW

SEQ ID NO: 35 - protein, 9 aa, Homo sapiens
VSTCPALIM

SEQ ID NO: 36 - protein, 7 aa, Homo sapiens
MFLIVWY

SEQ ID NO: 37 - protein, 4 aa, Homo sapiens
PAMQ

SEQ ID NO: 38 - protein, 9 aa, Homo sapiens
VMATSPLIC

SEQ ID NO: 39 - protein, 7 aa, Homo sapiens
MFLIVWY

SEQ ID NO: 40 - protein, 9 aa, Homo sapiens
IVMSACTPL

SEQ ID NO: 41 - protein, 6 aa, Homo sapiens
LIVMFY

SEQ ID NO: 42 - protein, 7 aa, Homo sapiens
LIVMFAY

SEQ ID NO: 43 - protein, 6 aa, Homo sapiens
DNQEST

SEQ ID NO: 44 - protein, 7 aa, Homo sapiens
MFLIVWY

SEQ ID NO: 45 - protein, 9 aa, Homo sapiens
VMSTACPLI

SEQ ID NO: 46 - protein, 6 aa, Homo sapiens
TILVMS

SEQ ID NO: 47 - protein, 7 aa, Homo sapiens
LIVMATQ

SEQ ID NO: 48 - protein, 6 aa, Homo sapiens
LIVMAT

SEQ ID NO: 49 - protein, 7 aa, Homo sapiens
VSMATLI

SEQ ID NO: 50 - protein, 8 aa, Homo sapiens
YFWIVLMT

SEQ ID NO: 51 - protein, 6 aa, Homo sapiens
FIYWLM

SEQ ID NO: 52 - protein, 8 aa, Homo sapiens
VILFMWYA

SEQ ID NO: 53 - protein, 8 aa, Homo sapiens
FYLWMIVA

SEQ ID NO: 54 - protein, 8 aa, Homo sapiens
FWYLIMVA

SEQ ID NO: 55 - protein, 8 aa, Homo sapiens
FWYLIVMA

SEQ ID NO: 56 - protein, 6 aa, Homo sapiens
QLIVMP

SEQ ID NO: 57 - protein, 8 aa, Homo sapiens
FWYMIVLA

SEQ ID NO: 58 - protein, 4 aa, Homo sapiens
GFYW

SEQ ID NO: 59 - protein, 8 aa, Homo sapiens
RHKLIVMP

SEQ ID NO: 60 - protein, 4 aa, Homo sapiens
GRHK

SEQ ID NO: 61 - protein, 8 aa, Homo sapiens
ASTCLIVM

SEQ ID NO: 62 - protein, 4 aa, Homo sapiens
GSTC

SEQ ID NO: 63 - protein, 4 aa, Homo sapiens
ASTC

SEQ ID NO: 64 - protein, 4 aa, Homo sapiens
LIVM

SEQ ID NO: 65 - protein, 9 aa, Homo sapiens
RHKDEPYFW

SEQ ID NO: 66 - protein, 5 aa, Homo sapiens
DEAQN

SEQ ID NO: 67 - protein, 5 aa, Homo sapiens
YFWQN

SEQ ID NO: 68 - protein, 5 aa, Homo sapiens
PASTC

SEQ ID NO: 69 - protein, 8 aa, Homo sapiens
RHKGLIVM

SEQ ID NO: 70 - protein, 6 aa, Homo sapiens
RHKYFW

SEQ ID NO: 71 - protein, 7 aa, Homo sapiens
STCLIVM

SEQ ID NO: 72 - protein, 4 aa, Homo sapiens
DEAS

SEQ ID NO: 73 - protein, 9 aa, Homo sapiens
RHKDEPYFW

SEQ ID NO: 74 - protein, 4 aa, Homo sapiens
PRHK

SEQ ID NO: 75 - protein, 7 aa, Homo sapiens
LMIVQAT

SEQ ID NO: 76 - protein, 6 aa, Homo sapiens
VLIMAT

SEQ ID NO: 77 - protein, 5 aa, Homo sapiens
DERKH

SEQ ID NO: 78 - protein, 4 aa, Homo sapiens
AYFW

SEQ ID NO: 79 - protein, 7 aa, Homo sapiens
LMIVQAT

SEQ ID NO: 80 - protein, 4 aa, Homo sapiens
LVIM

SEQ ID NO: 81 - protein, 7 aa, Homo sapiens
FYWLVIM

SEQ ID NO: 82 - protein, 4 aa, Homo sapiens
RKHA

SEQ ID NO: 83 - protein, 8 aa, Homo sapiens
DERKHRKH

SEQ ID NO: 84 - protein, 11 aa, Homo sapiens
LMVISATFCGD

SEQ ID NO: 85 - protein, 7 aa, Homo sapiens
PRHKYFW

SEQ ID NO: 86 - protein, 6 aa, Homo sapiens
KYRHFA

SEQ ID NO: 87 - protein, 12 aa, Homo sapiens
VTLMISAGNCDF

SEQ ID NO: 88 - protein, 4 aa, Homo sapiens
KRYH

SEQ ID NO: 89 - protein, 6 aa, Homo sapiens
YFWRHK

SEQ ID NO: 90 - protein, 4 aa, Homo sapiens
YFWM

SEQ ID NO: 91 - protein, 4 aa, Homo sapiens
FLIW

SEQ ID NO: 92 - protein, 6 aa, Homo sapiens
DERHKG

SEQ ID NO: 93 - protein, 4 aa, Homo sapiens
YFWM

SEQ ID NO: 94 - protein, 4 aa, Homo sapiens
YFWP

SEQ ID NO: 95 - protein, 4 aa, Homo sapiens
FLIW

SEQ ID NO: 96 - protein, 7 aa, Homo sapiens
MVTALIS

SEQ ID NO: 97 - protein, 8 aa, Homo sapiens
MVALFIST

SEQ ID NO: 98 - protein, 4 aa, Homo sapiens
AYFW

SEQ ID NO: 99 - protein, 6 aa, Homo sapiens
YFWSTC

SEQ ID NO: 100 - protein, 7 aa, Homo sapiens
AVTMSLI

SEQ ID NO: 101 - protein, 7 aa, Homo sapiens
YFWLIVM

SEQ ID NO: 102 - protein, 6 aa, Homo sapiens
RHKFWY

SEQ ID NO: 103 - protein, 8 aa, Homo sapiens
LMFWYAIV

SEQ ID NO: 104 - protein, 5 aa, Homo sapiens
DEQNP

SEQ ID NO: 105 - protein, 7 aa, Homo sapiens
FWYLIVM

SEQ ID NO: 106 - protein, 8 aa, Homo sapiens
LMFWYIVA

SEQ ID NO: 107 - protein, 4 aa, Homo sapiens
GFYW

SEQ ID NO: 108 - protein, 8 aa, Homo sapiens
RHKLIVMP

SEQ ID NO: 109 - protein, 4 aa, Homo sapiens
DEQN

SEQ ID NO: 110 - protein, 4 aa, Homo sapiens
GRHK

SEQ ID NO: 111 - protein, 8 aa, Homo sapiens
ASTCLIVM

SEQ ID NO: 112 - protein, 4 aa, Homo sapiens
DEAS

SEQ ID NO: 113 - protein, 4 aa, Homo sapiens
ASTC

SEQ ID NO: 114 - protein, 4 aa, Homo sapiens
LIVM

SEQ ID NO: 115 - protein, 9 aa, Homo sapiens
RHKDEPYFW

SEQ ID NO: 116 - protein, 7 aa, Homo sapiens
LIVMFWY

SEQ ID NO: 117 - protein, 8 aa, Homo sapiens
LIVFWYAM

SEQ ID NO: 118 - protein, 6 aa, Homo sapiens
AGPDER

SEQ ID NO: 119 - protein, 5 aa, Homo sapiens
HKSTC

SEQ ID NO: 120 - protein, 4 aa, Homo sapiens
DEQN

SEQ ID NO: 121 - protein, 7 aa, Homo sapiens
LIVMFWY

SEQ ID NO: 122 - protein, 10 aa, Homo sapiens
LIVMFWYFWY

SEQ ID NO: 123 - protein, 8 aa, Homo sapiens
IMFWYALV

SEQ ID NO: 124 - protein, 5 aa, Homo sapiens
AGPQN

SEQ ID NO: 125 - protein, 5 aa, Homo sapiens
RHKQN

SEQ ID NO: 126 - protein, 7 aa, Homo sapiens
FWYLIVM

SEQ ID NO: 127 - protein, 4 aa, Homo sapiens
LIVM

SEQ ID NO: 128 - protein, 5 aa, Homo sapiens
ALIVM

SEQ ID NO: 129 - protein, 5 aa, Homo sapiens
FWYAP

SEQ ID NO: 130 - protein, 9 aa, Homo sapiens
ATIVLMFWY

SEQ ID NO: 131 - protein, 6 aa, Homo sapiens
GPQNDE

SEQ ID NO: 132 - protein, 6 aa, Homo sapiens
GDESTC

SEQ ID NO: 133 - protein, 5 aa, Homo sapiens
RHKDE

SEQ ID NO: 134 - protein, 5 aa, Homo sapiens
QNDGE

SEQ ID NO: 135 - protein, 8 aa, Homo sapiens
AILMVFWY

SEQ ID NO: 136 - protein, 7 aa, Homo sapiens
AILMVST

SEQ ID NO: 137 - protein, 6 aa, Homo sapiens
AILMVT

SEQ ID NO: 138 - protein, 6 aa, Homo sapiens
AILMVT

SEQ ID NO: 139 - protein, 8 aa, Homo sapiens
YFWIVLMT

SEQ ID NO: 140 - protein, 6 aa, Homo sapiens
FIYWLM

SEQ ID NO: 141 - protein, 8 aa, Homo sapiens
FWYLIMVA

SEQ ID NO: 142 - protein, 6 aa, Homo sapiens
TILVMS

SEQ ID NO: 143 - protein, 6 aa, Homo sapiens
FYLWMI

SEQ ID NO: 144 - protein, 6 aa, Homo sapiens
QLIVMP

SEQ ID NO: 145 - protein, 6 aa, Homo sapiens
FWYMIV

SEQ ID NO: 146 - protein, 6 aa, Homo sapiens
FWYLIV

SEQ ID NO: 147 - protein, 4 aa, Homo sapiens
NASL

SEQ ID NO: 148 - protein, 4 aa, Homo sapiens
RRTS

SEQ ID NO: 149 - protein, 6 aa, Homo sapiens
GSIDTD

SEQ ID NO: 150 - protein, 123 aa, Homo sapiens
MKAVLLALLMAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

SEQ ID NO: 151 - protein, 190 aa, Homo sapiens [sequence omitted]

SEQ ID NO: 152 - protein, 17 aa, Homo sapiens
GPMPCSRLLPSLRCSLH

SEQ ID NO: 153 - protein, 19 aa, Homo sapiens
AGPMPCSRLLPSLRCSLHS

SEQ ID NO: 154 - protein, 29 aa, Homo sapiens
TCATPAGPMPCSRLLPSLRCSLHSACCSG

SEQ ID NO: 155 - protein, 17 aa, Homo sapiens
CCSGDPASSRLWGAPLQ

SEQ ID NO: 156 - protein, 19 aa, Homo sapiens
ACCSGDPASSRLWGAPLQP

SEQ ID NO: 157 - protein, 29 aa, Homo sapiens
CSLHSACCSGDPASSRLWGAPLQPTLGVV

SEQ ID NO: 158 - protein, 17 aa, Homo sapiens
QASVPLLTDPAQWEPVL

SEQ ID NO: 159 - protein, 19 aa, Homo sapiens
PQASVPLLTDPAQWEPVLV

SEQ ID NO: 160 - protein, 29 aa, Homo sapiens
TLGVVPQASVPLLTDPAQWEPVLVPEAHP

SEQ ID NO: 161 - protein, 16 aa, Homo sapiens
ASVPLLTDLAQWEPVL

SEQ ID NO: 162 - protein, 18 aa, Homo sapiens
QASVPLLTDLAQWEPVLV

SEQ ID NO: 163 - protein, 28 aa, Homo sapiens
LGVVPQASVPLLTDLAQWEPVLVPEAHP

SEQ ID NO: 164 - protein, 17 aa, Homo sapiens
ASVPLLTHLAQWEPVLV

SEQ ID NO: 165 - protein, 19 aa, Homo sapiens
QASVPLLTHLAQWEPVLVP

SEQ ID NO: 166 - protein, 29 aa, Homo sapiens
LGVVPQASVPLLTHLAQWEPVLVPEAHPN

SEQ ID NO: 167 - protein, 16 aa, Homo sapiens
ASLTMYVCTPVPHPDP

SEQ ID NO: 168 - protein, 19 aa, Homo sapiens
NASLTMYVCTPVPHPDPPM

SEQ ID NO: 169 - protein, 29 aa, Homo sapiens
PEAHPNASLTMYVCTPVPHPDPPMALSRT

SEQ ID NO: 170 - protein, 17 aa, Homo sapiens
SRTPTRQISSIDTDPPA

SEQ ID NO: 171 - protein, 19 aa, Homo sapiens
LSRTPTRQISSIDTDPPAD

SEQ ID NO: 172 - protein, 29 aa, Homo sapiens
DPPMALSRTPTRQISSIDTDPPADGPSNP

SEQ ID NO: 173 - protein, 15 aa, Homo sapiens
TPTRQISSSDTDPPA

SEQ ID NO: 174 - protein, 17 aa, Homo sapiens
RTPTRQISSSDTDPPAD

SEQ ID NO: 175 - protein, 27 aa, Homo sapiens
PMALSRTPTRQISSSDTDPPADGPSNP

SEQ ID NO: 176 - protein, 17 aa, Homo sapiens
TPTRQIGSSDTDPPADG

SEQ ID NO: 177 - protein, 19 aa, Homo sapiens
RTPTRQIGSSDTDPPADGP

SEQ ID NO: 178 - protein, 29 aa, Homo sapiens
PMALSRTPTRQIGSSDTDPPADGPSNPLC

SEQ ID NO: 179 - protein, 9 aa, Homo sapiens
RGQALRRAQ

SEQ ID NO: 180 - protein, 10 aa, Homo sapiens
SRGQALRRAQ

SEQ ID NO: 181 - protein, 15 aa, Homo sapiens
VSPAPSRGQALRRAQ

SEQ ID NO: 182 - protein, 9 aa, Homo sapiens
CVDDSQDYY

SEQ ID NO: 183 - protein, 9 aa, Homo sapiens
DTDLCNASG

SEQ ID NO: 184 - protein, 9 aa, Homo sapiens
LGEQCWTAR

SEQ ID NO: 185 - protein, 9 aa, Homo sapiens
SQDYYVGKK

SEQ ID NO: 186 - protein, 9 aa, Homo sapiens
QVENCTQLG

SEQ ID NO: 187 - protein, 9 aa, Homo sapiens
QPGTALLCY

SEQ ID NO: 188 - protein, 9 aa, Homo sapiens
DSQDYYVGK

SEQ ID NO: 189 - protein, 9 aa, Homo sapiens
NCVDDSQDY

SEQ ID NO: 190 - protein, 9 aa, Homo sapiens
CCDTDLCNA

SEQ ID NO: 191 - protein, 9 aa, Homo sapiens
VGLLTVISK

SEQ ID NO: 192 - protein, 9 aa, Homo sapiens
ALQPAAAIL

SEQ ID NO: 193 - protein, 9 aa, Homo sapiens
ALQPGTALL

SEQ ID NO: 194 - protein, 9 aa, Homo sapiens
TALLCYSCK

SEQ ID NO: 195 - protein, 9 aa, Homo sapiens
ALLPALGLL

SEQ ID NO: 196 - protein, 9 aa, Homo sapiens
VSNEDCLQV

SEQ ID NO: 197 - protein, 9 aa, Homo sapiens
TCCDTDLCN

SEQ ID NO: 198 - protein, 9 aa, Homo sapiens
LALLPALGL

SEQ ID NO: 199 - protein, 9 aa, Homo sapiens
KAVLLALLM

SEQ ID NO: 200 - protein, 9 aa, Homo sapiens
AVLLALLMA

SEQ ID NO: 201 - protein, 9 aa, Homo sapiens
AAILALLPA

SEQ ID NO: 202 - protein, 9 aa, Homo sapiens
VDDSQDYYV

SEQ ID NO: 203 - protein, 9 aa, Homo sapiens
GTALLCYSC

SEQ ID NO: 204 - protein, 9 aa, Homo sapiens
VLLALLMAG

SEQ ID NO: 205 - protein, 9 aa, Homo sapiens
NEDCLQVEN

SEQ ID NO: 206 - protein, 9 aa, Homo sapiens
ALLMAGLAL

SEQ ID NO: 207 - protein, 9 aa, Homo sapiens
LLPALGLLL

SEQ ID NO: 208 - protein, 9 aa, Homo sapiens
ITCCDTDLC

SEQ ID NO: 209 - protein, 9 aa, Homo sapiens
CTQLGEQCW

SEQ ID NO: 210 - protein, 9 aa, Homo sapiens
LTVISKGCS

SEQ ID NO: 211 - protein, 9 aa, Homo sapiens
SNEDCLQVE

SEQ ID NO: 212 - protein, 9 aa, Homo sapiens
LCYSCKAQV

SEQ ID NO: 213 - protein, 9 aa, Homo sapiens
ILALLPALG

SEQ ID NO: 214 - protein, 9 aa, Homo sapiens
LLMAGLALQ

SEQ ID NO: 215 - protein, 9 aa, Homo sapiens
LCNASGAHA

SEQ ID NO: 216 - protein, 9 aa, Homo sapiens
LLALLMAGL

SEQ ID NO: 217 - protein, 9 aa, Homo sapiens
HALQPAAAI

SEQ ID NO: 218 - protein, 9 aa, Homo sapiens
AILALLPAL

SEQ ID NO: 219 - protein, 9 aa, Homo sapiens
GAHALQPAA

SEQ ID NO: 220 - protein, 9 aa, Homo sapiens
NASGAHALQ

SEQ ID NO: 221 - protein, 9 aa, Homo sapiens
AVGLLTVIS

SEQ ID NO: 222 - protein, 9 aa, Homo sapiens
GLLLWGPGQ

SEQ ID NO: 223 - protein, 9 aa, Homo sapiens
CSLNCVDDS

SEQ ID NO: 224 - protein, 9 aa, Homo sapiens
EQCWTARIR

SEQ ID NO: 225 - protein, 9 aa, Homo sapiens
QPAAAILAL

SEQ ID NO: 226 - protein, 9 aa, Homo sapiens
LPALGLLLW

SEQ ID NO: 227 - protein, 9 aa, Homo sapiens
LLTVISKGC

SEQ ID NO: 228 - protein, 9 aa, Homo sapiens
LLLWGPGQL

SEQ ID NO: 229 - protein, 9 aa, Homo sapiens
LALQPGTAL

SEQ ID NO: 230 - protein, 9 aa, Homo sapiens
KAQVSNEDC

SEQ ID NO: 231 - protein, 9 aa, Homo sapiens
ALLCYSCKA

SEQ ID NO: 232 - protein, 9 aa, Homo sapiens
CLQVENCTQ

SEQ ID NO: 233 - protein, 9 aa, Homo sapiens
QLGEQCWTA

SEQ ID NO: 234 - protein, 9 aa, Homo sapiens
QVSNEDCLQ

SEQ ID NO: 235 - protein, 9 aa, Homo sapiens
DCLQVENCT

SEQ ID NO: 236 - protein, 9 aa, Homo sapiens
RAVGLLTVI

SEQ ID NO: 237 - protein, 9 aa, Homo sapiens
NCTQLGEQC

SEQ ID NO: 238 - protein, 9 aa, Homo sapiens
GLALQPGTA

SEQ ID NO: 239 - protein, 9 aa, Homo sapiens
NITCCDTDL

SEQ ID NO: 240 - protein, 9 aa, Homo sapiens
LALLMAGLA

SEQ ID NO: 241 - protein, 9 aa, Homo sapiens
LLCYSCKAQ

SEQ ID NO: 242 - protein, 9 aa, Homo sapiens
DLCNASGAH

SEQ ID NO: 243 - protein, 9 aa, Homo sapiens
TVISKGCSL

SEQ ID NO: 244 - protein, 9 aa, Homo sapiens
SLNCVDDSQ

SEQ ID NO: 245 - protein, 9 aa, Homo sapiens
MAGLALQPG

SEQ ID NO: 246 - protein, 9 aa, Homo sapiens
GLLTVISKG

SEQ ID NO: 247 - protein, 9 aa, Homo sapiens
ISKGCSLNC

SEQ ID NO: 248 - protein, 9 aa, Homo sapiens
ASGAHALQP

SEQ ID NO: 249 - protein, 9 aa, Homo sapiens
LQPAAAILA

SEQ ID NO: 250 - protein, 9 aa, Homo sapiens
LQPGTALLC

SEQ ID NO: 251 - protein, 9 aa, Homo sapiens
QCWTARIRA

SEQ ID NO: 252 - protein, 9 aa, Homo sapiens
RIRAVGLLT

SEQ ID NO: 253 - protein, 9 aa, Homo sapiens
YVGKKNITC

SEQ ID NO: 254 - protein, 9 aa, Homo sapiens
PALGLLLWG

SEQ ID NO: 255 - protein, 9 aa, Homo sapiens
AGLALQPGT

SEQ ID NO: 256 - protein, 9 aa, Homo sapiens
WTARIRAVG

SEQ ID NO: 257 - protein, 9 aa, Homo sapiens
AAAILALLP

SEQ ID NO: 258 - protein, 9 aa, Homo sapiens
YSCKAQVSN

SEQ ID NO: 259 - protein, 9 aa, Homo sapiens
ENCTQLGEQ

SEQ ID NO: 260 - protein, 9 aa, Homo sapiens
LGLLLWGPG

SEQ ID NO: 261 - protein, 9 aa, Homo sapiens
SGAHALQPA

SEQ ID NO: 262 - protein, 9 aa, Homo sapiens
LMAGLALQP

SEQ ID NO: 263 - protein, 9 aa, Homo sapiens
CNASGAHAL

SEQ ID NO: 264 - protein, 9 aa, Homo sapiens
IRAVGLLTV

SEQ ID NO: 265 - protein, 9 aa, Homo sapiens
TARIRAVGL

SEQ ID NO: 266 - protein, 9 aa, Homo sapiens
PAAAILALL

SEQ ID NO: 267 - protein, 9 aa, Homo sapiens
GCSLNCVDD

SEQ ID NO: 268 - protein, 9 aa, Homo sapiens
TQLGEQCWT

SEQ ID NO: 269 - protein, 9 aa, Homo sapiens
AQVSNEDCL

SEQ ID NO: 270 - protein, 9 aa, Homo sapiens
LQVENCTQL

SEQ ID NO: 271 - protein, 9 aa, Homo sapiens
ALGLLLWGP

SEQ ID NO: 272 - protein, 9 aa, Homo sapiens
GEQCWTARI

SEQ ID NO: 273 - protein, 9 aa, Homo sapiens
DDSQDYYVG

SEQ ID NO: 274 - protein, 9 aa, Homo sapiens
AHALQPAAA

SEQ ID NO: 275 - protein, 9 aa, Homo sapiens
MKAVLLALL

SEQ ID NO: 276 - protein, 9 aa, Homo sapiens
VISKGCSLN

SEQ ID NO: 277 - protein, 9 aa, Homo sapiens
DYYVGKKNI

SEQ ID NO: 278 - protein, 9 aa, Homo sapiens
CWTARIRAV

SEQ ID NO: 279 - protein, 9 aa, Homo sapiens
EDCLQVENC

SEQ ID NO: 280 - protein, 9 aa, Homo sapiens
KKNITCCDT

SEQ ID NO: 281 - protein, 9 aa, Homo sapiens
TDLCNASGA

SEQ ID NO: 282 - protein, 9 aa, Homo sapiens
EAFPAHPIY

SEQ ID NO: 283 - protein, 9 aa, Homo sapiens
SGDPASYRL

SEQ ID NO: 284 - protein, 9 aa, Homo sapiens
HPDPPMALS

SEQ ID NO: 285 - protein, 9 aa, Homo sapiens
DTDPPADGP

SEQ ID NO: 286 - protein, 9 aa, Homo sapiens
CCSGDPASY

SEQ ID NO: 287 - protein, 9 aa, Homo sapiens
FSTLNPVLR

SEQ ID NO: 288 - protein, 9 aa, Homo sapiens
VPEAHPNAS

SEQ ID NO: 289 - protein, 9 aa, Homo sapiens
MALSRTPTR

SEQ ID NO: 290 - protein, 9 aa, Homo sapiens
CCCFHGPAF

SEQ ID NO: 291 - protein, 9 aa, Homo sapiens
SVVSPAPSR

SEQ ID NO: 292 - protein, 9 aa, Homo sapiens
PSNPLCCCF

SEQ ID NO: 293 - protein, 9 aa, Homo sapiens
CSGDPASYR

SEQ ID NO: 294 - protein, 9 aa, Homo sapiens
HPNASLTMY

SEQ ID NO: 295 - protein, 9 aa, Homo sapiens
ATPAGPMPC

SEQ ID NO: 296 - protein, 9 aa, Homo sapiens
RTPTRQIGS

SEQ ID NO: 297 - protein, 9 aa, Homo sapiens
STLNPVLRH

SEQ ID NO: 298 - protein, 9 aa, Homo sapiens
VLVPEAHPN

SEQ ID NO: 299 - protein, 9 aa, Homo sapiens
RLPPSLRCS

SEQ ID NO: 300 - protein, 9 aa, Homo sapiens
EAHPNASLT

SEQ ID NO: 301 - protein, 9 aa, Homo sapiens
PAGPMPCSR

SEQ ID NO: 302 - protein, 9 aa, Homo sapiens
TLNPVLRHL

SEQ ID NO: 303 - protein, 9 aa, Homo sapiens
VVSPAPSRG

SEQ ID NO: 304 - protein, 9 aa, Homo sapiens
SIDTDPPAD

SEQ ID NO: 305 - protein, 9 aa, Homo sapiens
QWEPVLVPE

SEQ ID NO: 306 - protein, 9 aa, Homo sapiens
IYDLSQVWS

SEQ ID NO: 307 - protein, 9 aa, Homo sapiens
LTMYVCAPV

SEQ ID NO: 308 - protein, 9 aa, Homo sapiens
PADGPSNPL

SEQ ID NO: 309 - protein, 9 aa, Homo sapiens
VPHPDPPMA

SEQ ID NO: 310 - protein, 9 aa, Homo sapiens
WGAPLQPTL

SEQ ID NO: 311 - protein, 9 aa, Homo sapiens
QASVPLLTH

SEQ ID NO: 312 - protein, 9 aa, Homo sapiens
GSIDTDPPA

SEQ ID NO: 313 - protein, 9 aa, Homo sapiens
ASLTMYVCA

SEQ ID NO: 314 - protein, 9 aa, Homo sapiens
LSQVWSVVS

SEQ ID NO: 315 - protein, 9 aa, Homo sapiens
WSVVSPAPS

SEQ ID NO: 316 - protein, 9 aa, Homo sapiens
PDPPMALSR

SEQ ID NO: 317 - protein, 9 aa, Homo sapiens
SRLPPSLRC

SEQ ID NO: 318 - protein, 9 aa, Homo sapiens
LNPVLRHLF

SEQ ID NO: 319 - protein, 9 aa, Homo sapiens
RGQALRRAR

SEQ ID NO: 320 - protein, 9 aa, Homo sapiens
SPAPSRGQA

SEQ ID NO: 321 - protein, 9 aa, Homo sapiens
VTPTCATPA

SEQ ID NO: 322 - protein, 9 aa, Homo sapiens
LTHPAQWEP

SEQ ID NO: 323 - protein, 9 aa, Homo sapiens
RTTTWARRT

SEQ ID NO: 324 - protein, 9 aa, Homo sapiens
TTWARRTSR

SEQ ID NO: 325 - protein, 9 aa, Homo sapiens
TTTWARRTS

SEQ ID NO: 326 - protein, 9 aa, Homo sapiens
NASLTMYVC

SEQ ID NO: 327 - protein, 9 aa, Homo sapiens
ACCSGDPAS

SEQ ID NO: 328 - protein, 9 aa, Homo sapiens
RCSLHSACC

SEQ ID NO: 329 - protein, 9 aa, Homo sapiens
AVTPTCATP

SEQ ID NO: 330 - protein, 9 aa, Homo sapiens
CATPAGPMP

SEQ ID NO: 331 - protein, 9 aa, Homo sapiens
LVPEAHPNA

SEQ ID NO: 332 - protein, 9 aa, Homo sapiens
VVPQASVPL

SEQ ID NO: 333 - protein, 9 aa, Homo sapiens
CCFHGPAFS

SEQ ID NO: 334 - protein, 9 aa, Homo sapiens
HLFPQEAFP

SEQ ID NO: 335 - protein, 9 aa, Homo sapiens
CSRLPPSLR

SEQ ID NO: 336 - protein, 9 aa, Homo sapiens
ASVPLLTHP

SEQ ID NO: 337 - protein, 9 aa, Homo sapiens
VSPAPSRGQ

SEQ ID NO: 338 - protein, 9 aa, Homo sapiens
CSLHSACCS

SEQ ID NO: 339 - protein, 9 aa, Homo sapiens
DGPSNPLCC

SEQ ID NO: 340 - protein, 9 aa, Homo sapiens
NPLCCCFHG

SEQ ID NO: 341 - protein, 9 aa, Homo sapiens
DPASYRLWG

SEQ ID NO: 342 - protein, 9 aa, Homo sapiens
APLQPTLGV

SEQ ID NO: 343 - protein, 9 aa, Homo sapiens
PAHPIYDLS

SEQ ID NO: 344 - protein, 9 aa, Homo sapiens
HRTTTWARR

SEQ ID NO: 345 - protein, 9 aa, Homo sapiens
SACCSGDPA

SEQ ID NO: 346 - protein, 9 aa, Homo sapiens
TCATPAGPM

SEQ ID NO: 347 - protein, 9 aa, Homo sapiens
PLQPTLGVV

SEQ ID NO: 348 - protein, 9 aa, Homo sapiens
RAVTPTCAT

SEQ ID NO: 349 - protein, 9 aa, Homo sapiens
GVVPQASVP

SEQ ID NO: 350 - protein, 9 aa, Homo sapiens
LCCCFHGPA

SEQ ID NO: 351 - protein, 9 aa, Homo sapiens
ADGPSNPLC

SEQ ID NO: 352 - protein, 9 aa, Homo sapiens
VCAPVPHPD

SEQ ID NO: 353 - protein, 9 aa, Homo sapiens
GAPLQPTLG

SEQ ID NO: 354 - protein, 9 aa, Homo sapiens
TLGVVPQAS

SEQ ID NO: 355 - protein, 9 aa, Homo sapiens
DLSQVWSVV

SEQ ID NO: 356 - protein, 9 aa, Homo sapiens
SLHSACCSG

SEQ ID NO: 357 - protein, 9 aa, Homo sapiens
SVPLLTHPA

SEQ ID NO: 358 - protein, 9 aa, Homo sapiens
PSRGQALRR

SEQ ID NO: 359 - protein, 9 aa, Homo sapiens
VPQASVPLL

SEQ ID NO: 360 - protein, 9 aa, Homo sapiens
TDPPADGPS

SEQ ID NO: 361 - protein, 9 aa, Homo sapiens
FHGPAFSTL

SEQ ID NO: 362 - protein, 9 aa, Homo sapiens
LGVVPQASV

SEQ ID NO: 363 - protein, 9 aa, Homo sapiens
DPPADGPSN

SEQ ID NO: 364 - protein, 9 aa, Homo sapiens
TPAGPMPCS

SEQ ID NO: 365 - protein, 9 aa, Homo sapiens
HPAQWEPVL

SEQ ID NO: 366 - protein, 9 aa, Homo sapiens
TPTCATPAG

SEQ ID NO: 367 - protein, 9 aa, Homo sapiens
SRTPTRQIG

SEQ ID NO: 368 - protein, 9 aa, Homo sapiens
VPLLTHPAQ

SEQ ID NO: 369 - protein, 9 aa, Homo sapiens
FPAHPIYDL

SEQ ID NO: 370 - protein, 9 aa, Homo sapiens
RHLFPQEAF

SEQ ID NO: 371 - protein, 9 aa, Homo sapiens
QPTLGVVPQ

SEQ ID NO: 372 - protein, 9 aa, Homo sapiens
APSRGQALR

SEQ ID NO: 373 - protein, 9 aa, Homo sapiens
MPCSRLPPS

SEQ ID NO: 374 - protein, 9 aa, Homo sapiens
FPQEAFPAH

SEQ ID NO: 375 - protein, 9 aa, Homo sapiens
PTLGVVPQA

SEQ ID NO: 376 - protein, 9 aa, Homo sapiens
TSRAVTPTC

SEQ ID NO: 377 - protein, 9 aa, Homo sapiens
PQEAFPAHP

SEQ ID NO: 378 - protein, 9 aa, Homo sapiens
AGPMPCSRL

SEQ ID NO: 379 - protein, 9 aa, Homo sapiens
CFHGPAFST

SEQ ID NO: 380 - protein, 9 aa, Homo sapiens
HGPAFSTLN

SEQ ID NO: 381 - protein, 9 aa, Homo sapiens
AHPNASLTM

SEQ ID NO: 382 - protein, 9 aa, Homo sapiens
RLLPSLRCS

SEQ ID NO: 383 - protein, 9 aa, Homo sapiens
GPMPCSRLL

SEQ ID NO: 384 - protein, 9 aa, Homo sapiens
CSRLLPSLR

SEQ ID NO: 385 - protein, 9 aa, Homo sapiens
MPCSRLLPS

SEQ ID NO: 386 - protein, 9 aa, Homo sapiens
LLPSLRCSL

SEQ ID NO: 387 - protein, 9 aa, Homo sapiens
SRLLPSLRC

SEQ ID NO: 388 - protein, 9 aa, Homo sapiens
LPSLRCSLH

SEQ ID NO: 389 - protein, 9 aa, Homo sapiens
PMPCSRLLP

SEQ ID NO: 390 - protein, 9 aa, Homo sapiens
PCSRLLPSL

SEQ ID NO: 391 - protein, 9 aa, Homo sapiens
SGDPASSRL

SEQ ID NO: 392 - protein, 9 aa, Homo sapiens
CSGDPASSR

SEQ ID NO: 393 - protein, 9 aa, Homo sapiens
CCSGDPASS

SEQ ID NO: 394 - protein, 9 aa, Homo sapiens
DPASSRLWG

SEQ ID NO: 395 - protein, 9 aa, Homo sapiens
SSRLWGAPL

SEQ ID NO: 396 - protein, 9 aa, Homo sapiens
PASSRLWGA

SEQ ID NO: 397 - protein, 9 aa, Homo sapiens
SRLWGAPLQ

SEQ ID NO: 398 - protein, 9 aa, Homo sapiens
GDPASSRLW

SEQ ID NO: 399 - protein, 9 aa, Homo sapiens
ASSRLWGAP

SEQ ID NO: 400 - protein, 9 aa, Homo sapiens
LTDPAQWEP

SEQ ID NO: 401 - protein, 9 aa, Homo sapiens
ASVPLLTDP

SEQ ID NO: 402 - protein, 9 aa, Homo sapiens
SVPLLTDPA

SEQ ID NO: 403 - protein, 9 aa, Homo sapiens
DPAQWEPVL

SEQ ID NO: 404 - protein, 9 aa, Homo sapiens
QASVPLLTD

SEQ ID NO: 405 - protein, 9 aa, Homo sapiens
VPLLTDPAQ

SEQ ID NO: 406 - protein, 9 aa, Homo sapiens
PLLTDPAQW

SEQ ID NO: 407 - protein, 9 aa, Homo sapiens
LLTDPAQWE

SEQ ID NO: 408 - protein, 9 aa, Homo sapiens
TDPAQWEPV

SEQ ID NO: 409 - protein, 9 aa, Homo sapiens
ASVPLLTDL

SEQ ID NO: 410 - protein, 9 aa, Homo sapiens
LTDLAQWEP

SEQ ID NO: 411 - protein, 9 aa, Homo sapiens
DLAQWEPVL

SEQ ID NO: 412 - protein, 9 aa, Homo sapiens
VPLLTDLAQ

SEQ ID NO: 413 - protein, 9 aa, Homo sapiens
SVPLLTDLA

SEQ ID NO: 414 - protein, 9 aa, Homo sapiens
PLLTDLAQW

SEQ ID NO: 415 - protein, 9 aa, Homo sapiens
LLTDLAQWE

SEQ ID NO: 416 - protein, 9 aa, Homo sapiens
TDLAQWEPV

SEQ ID NO: 417 - protein, 9 aa, Homo sapiens
ASVPLLTHL

SEQ ID NO: 418 - protein, 9 aa, Homo sapiens
HLAQWEPVL

SEQ ID NO: 419 - protein, 9 aa, Homo sapiens
LAQWEPVLV

SEQ ID NO: 420 - protein, 9 aa, Homo sapiens
VPLLTHLAQ

SEQ ID NO: 421 - protein, 9 aa, Homo sapiens
SVPLLTHLA

SEQ ID NO: 422 - protein, 9 aa, Homo sapiens
LTHLAQWEP

SEQ ID NO: 423 - protein, 9 aa, Homo sapiens
PLLTHLAQW

SEQ ID NO: 424 - protein, 9 aa, Homo sapiens
LLTHLAQWE

SEQ ID NO: 425 - protein, 9 aa, Homo sapiens
THLAQWEPV

SEQ ID NO: 426 - protein, 9 aa, Homo sapiens
ASLTMYVCT

SEQ ID NO: 427 - protein, 9 aa, Homo sapiens
LTMYVCTPV

SEQ ID NO: 428 - protein, 9 aa, Homo sapiens
VCTPVPHPD

SEQ ID NO: 429 - protein, 9 aa, Homo sapiens
CTPVPHPDP

SEQ ID NO: 430 - protein, 9 aa, Homo sapiens
YVCTPVPHP

SEQ ID NO: 431 - protein, 9 aa, Homo sapiens
TMYVCTPVP

SEQ ID NO: 432 - protein, 9 aa, Homo sapiens
SLTMYVCTP

SEQ ID NO: 433 - protein, 9 aa, Homo sapiens
MYVCTPVPH

SEQ ID NO: 434 - protein, 9 aa, Homo sapiens
RTPTRQISS

SEQ ID NO: 435 - protein, 9 aa, Homo sapiens
SSIDTDPPA

SEQ ID NO: 436 - protein, 9 aa, Homo sapiens
SRTPTRQIS

SEQ ID NO: 437 - protein, 9 aa, Homo sapiens
TRQISSIDT

SEQ ID NO: 438 - protein, 9 aa, Homo sapiens
ISSIDTDPP

SEQ ID NO: 439 - protein, 9 aa, Homo sapiens
QISSIDTDP

SEQ ID NO: 440 - protein, 9 aa, Homo sapiens
TPTRQISSI

SEQ ID NO: 441 - protein, 9 aa, Homo sapiens
RQISSIDTD

SEQ ID NO: 442 - protein, 9 aa, Homo sapiens
PTRQISSID

SEQ ID NO: 443 - protein, 9 aa, Homo sapiens
SSSDTDPPA

SEQ ID NO: 444 - protein, 9 aa, Homo sapiens
ISSSDTDPP

SEQ ID NO: 445 - protein, 9 aa, Homo sapiens
QISSSDTDP

SEQ ID NO: 446 - protein, 9 aa, Homo sapiens
TRQISSSDT

SEQ ID NO: 447 - protein, 9 aa, Homo sapiens
TPTRQISSS

SEQ ID NO: 448 - protein, 9 aa, Homo sapiens
RQISSSDTD

SEQ ID NO: 449 - protein, 9 aa, Homo sapiens
PTRQISSSD

SEQ ID NO: 450 - protein, 9 aa, Homo sapiens
SSDTDPPAD

SEQ ID NO: 451 - protein, 9 aa, Homo sapiens
GSSDTDPPA

SEQ ID NO: 452 - protein, 9 aa, Homo sapiens
SDTDPPADG

SEQ ID NO: 453 - protein, 9 aa, Homo sapiens
QIGSSDTDP

SEQ ID NO: 454 - protein, 9 aa, Homo sapiens
TRQIGSSDT

SEQ ID NO: 455 - protein, 9 aa, Homo sapiens
IGSSDTDPP

SEQ ID NO: 456 - protein, 9 aa, Homo sapiens
TPTRQIGSS

SEQ ID NO: 457 - protein, 9 aa, Homo sapiens
RQIGSSDTD

SEQ ID NO: 458 - protein, 9 aa, Homo sapiens
PTRQIGSSD

SEQ ID NO: 459 - protein, 9 aa, Homo sapiens
RGQALRRAQ

SEQ ID NO: 460 - protein, 9 aa, Homo sapiens
SRGQALRRA

SEQ ID NO: 461 - protein, 10 aa, Homo sapiens
DTDLCNASGA

SEQ ID NO: 462 - protein, 10 aa, Homo sapiens
CVDDSQDYYV

SEQ ID NO: 463 - protein, 10 aa, Homo sapiens
AVGLLTVISK

SEQ ID NO: 464 - protein, 10 aa, Homo sapiens
ALLPALGLLL

SEQ ID NO: 465 - protein, 10 aa, Homo sapiens
ALQPAAAILA

SEQ ID NO: 466 - protein, 10 aa, Homo sapiens
ALQPGTALLC

SEQ ID NO: 467 - protein, 10 aa, Homo sapiens
CCDTDLCNAS

SEQ ID NO: 468 - protein, 10 aa, Homo sapiens
GTALLCYSCK

SEQ ID NO: 469 - protein, 10 aa, Homo sapiens
NCVDDSQDYY

SEQ ID NO: 470 - protein, 10 aa, Homo sapiens
SNEDCLQVEN

SEQ ID NO: 471 - protein, 10 aa, Homo sapiens
LGEQCWTARI

SEQ ID NO: 472 - protein, 10 aa, Homo sapiens
QVENCTQLGE

SEQ ID NO: 473 - protein, 10 aa, Homo sapiens
LQPGTALLCY

SEQ ID NO: 474 - protein, 10 aa, Homo sapiens
DSQDYYVGKK

SEQ ID NO: 475 - protein, 10 aa, Homo sapiens
ITCCDTDLCN

SEQ ID NO: 476 - protein, 10 aa, Homo sapiens
LNCVDDSQDY

SEQ ID NO: 477 - protein, 10 aa, Homo sapiens
QLGEQCWTAR

SEQ ID NO: 478 - protein, 10 aa, Homo sapiens
SQDYYVGKKN

SEQ ID NO: 479 - protein, 10 aa, Homo sapiens
QVSNEDCLQV

SEQ ID NO: 480 - protein, 10 aa, Homo sapiens
AVLLALLMAG

SEQ ID NO: 481 - protein, 10 aa, Homo sapiens
AAAILALLPA

SEQ ID NO: 482 - protein, 10 aa, Homo sapiens
LLPALGLLLW

SEQ ID NO: 483 - protein, 10 aa, Homo sapiens
LALLMAGLAL

SEQ ID NO: 484 - protein, 10 aa, Homo sapiens
KAVLLALLMA

SEQ ID NO: 485 - protein, 10 aa, Homo sapiens
ILALLPALGL

SEQ ID NO: 486 - protein, 10 aa, Homo sapiens
VDDSQDYYVG

SEQ ID NO: 487 - protein, 10 aa, Homo sapiens
CTQLGEQCWT

SEQ ID NO: 488 - protein, 10 aa, Homo sapiens
NEDCLQVENC

SEQ ID NO: 489 - protein, 10 aa, Homo sapiens
LTVISKGCSL

SEQ ID NO: 490 - protein, 10 aa, Homo sapiens
VLLALLMAGL

SEQ ID NO: 491 - protein, 10 aa, Homo sapiens
DDSQDYYVGK

SEQ ID NO: 492 - protein, 10 aa, Homo sapiens
MAGLALQPGT

SEQ ID NO: 493 - protein, 10 aa, Homo sapiens
AAILALLPAL

SEQ ID NO: 494 - protein, 10 aa, Homo sapiens
LLCYSCKAQV

SEQ ID NO: 495 - protein, 10 aa, Homo sapiens
GAHALQPAAA

SEQ ID NO: 496 - protein, 10 aa, Homo sapiens
AILALLPALG

SEQ ID NO: 497 - protein, 10 aa, Homo sapiens
DLCNASGAHA

SEQ ID NO: 498 - protein, 10 aa, Homo sapiens
LALQPGTALL

SEQ ID NO: 499 - protein, 10 aa, Homo sapiens
HALQPAAAIL

SEQ ID NO: 500 - protein, 10 aa, Homo sapiens
ALLMAGLALQ

SEQ ID NO: 501 - protein, 10 aa, Homo sapiens
RAVGLLTVIS

SEQ ID NO: 502 - protein, 10 aa, Homo sapiens
ASGAHALQPA

SEQ ID NO: 503 - protein, 10 aa, Homo sapiens
CSLNCVDDSQ

SEQ ID NO: 504 - protein, 10 aa, Homo sapiens
LPALGLLLWG

SEQ ID NO: 505 - protein, 10 aa, Homo sapiens
GLALQPGTAL

SEQ ID NO: 506 - protein, 10 aa, Homo sapiens
TCCDTDLCNA

SEQ ID NO: 507 - protein, 10 aa, Homo sapiens
ALLCYSCKAQ

SEQ ID NO: 508 - protein, 10 aa, Homo sapiens
LCYSCKAQVS

SEQ ID NO: 509 - protein, 10 aa, Homo sapiens
LLALLMAGLA

SEQ ID NO: 510 - protein, 10 aa, Homo sapiens
CLQVENCTQL

SEQ ID NO: 511 - protein, 10 aa, Homo sapiens
LLTVISKGCS

SEQ ID NO: 512 - protein, 10 aa, Homo sapiens
TALLCYSCKA

SEQ ID NO: 513 - protein, 10 aa, Homo sapiens
TVISKGCSLN

SEQ ID NO: 514 - protein, 10 aa, Homo sapiens
DCLQVENCTQ

SEQ ID NO: 515 - protein, 10 aa, Homo sapiens
GLLLWGPGQL

SEQ ID NO: 516 - protein, 10 aa, Homo sapiens
KAQVSNEDCL

SEQ ID NO: 517 - protein, 10 aa, Homo sapiens
ALGLLLWGPG

SEQ ID NO: 518 - protein, 10 aa, Homo sapiens
LALLPALGLL

SEQ ID NO: 519 - protein, 10 aa, Homo sapiens
GCSLNCVDDS

SEQ ID NO: 520 - protein, 10 aa, Homo sapiens
LCNASGAHAL

SEQ ID NO: 521 - protein, 10 aa, Homo sapiens
NCTQLGEQCW

SEQ ID NO: 522 - protein, 10 aa, Homo sapiens
GLLTVISKGC

SEQ ID NO: 523 - protein, 10 aa, Homo sapiens
NITCCDTDLC

SEQ ID NO: 524 - protein, 10 aa, Homo sapiens
EQCWTARIRA

SEQ ID NO: 525 - protein, 10 aa, Homo sapiens
LQPAAAILAL

SEQ ID NO: 526 - protein, 10 aa, Homo sapiens
VISKGCSLNC

SEQ ID NO: 527 - protein, 10 aa, Homo sapiens
CNASGAHALQ

SEQ ID NO: 528 - protein, 10 aa, Homo sapiens
SGAHALQPAA

SEQ ID NO: 529 - protein, 10 aa, Homo sapiens
GEQCWTARIR

SEQ ID NO: 530 - protein, 10 aa, Homo sapiens
RIRAVGLLTV

SEQ ID NO: 531 - protein, 10 aa, Homo sapiens
LGLLLWGPGQ

SEQ ID NO: 532 - protein, 10 aa, Homo sapiens
NASGAHALQP

SEQ ID NO: 533 - protein, 10 aa, Homo sapiens
WTARIRAVGL

SEQ ID NO: 534 - protein, 10 aa, Homo sapiens
LLMAGLALQP

SEQ ID NO: 535 - protein, 10 aa, Homo sapiens
LMAGLALQPG

SEQ ID NO: 536 - protein, 10 aa, Homo sapiens
QPAAAILALL

SEQ ID NO: 537 - protein, 10 aa, Homo sapiens
YYVGKKNITC

SEQ ID NO: 538 - protein, 10 aa, Homo sapiens
KNITCCDTDL

SEQ ID NO: 539 - protein, 10 aa, Homo sapiens
AGLALQPGTA

SEQ ID NO: 540 - protein, 10 aa, Homo sapiens
QPGTALLCYS

SEQ ID NO: 541 - protein, 10 aa, Homo sapiens
MKAVLLALLM

SEQ ID NO: 542 - protein, 10 aa, Homo sapiens
VGLLTVISKG

SEQ ID NO: 543 - protein, 10 aa, Homo sapiens
ENCTQLGEQC

SEQ ID NO: 544 - protein, 10 aa, Homo sapiens
ISKGCSLNCV

SEQ ID NO: 545 - protein, 10 aa, Homo sapiens
VSNEDCLQVE

SEQ ID NO: 546 - protein, 10 aa, Homo sapiens
AQVSNEDCLQ

SEQ ID NO: 547 - protein, 10 aa, Homo sapiens
LQVENCTQLG

SEQ ID NO: 548 - protein, 10 aa, Homo sapiens
TQLGEQCWTA

SEQ ID NO: 549 - protein, 10 aa, Homo sapiens
CWTARIRAVG

SEQ ID NO: 550 - protein, 10 aa, Homo sapiens
SLNCVDDSQD

SEQ ID NO: 551 - protein, 10 aa, Homo sapiens
YVGKKNITCC

SEQ ID NO: 552 - protein, 10 aa, Homo sapiens
CDTDLCNASG

SEQ ID NO: 553 - protein, 10 aa, Homo sapiens
AHALQPAAAI

SEQ ID NO: 554 - protein, 10 aa, Homo sapiens
QCWTARIRAV

SEQ ID NO: 555 - protein, 10 aa, Homo sapiens
CYSCKAQVSN

SEQ ID NO: 556 - protein, 10 aa, Homo sapiens
TARIRAVGLL

SEQ ID NO: 557 - protein, 10 aa, Homo sapiens
PAAAILALLP

SEQ ID NO: 558 - protein, 10 aa, Homo sapiens
CKAQVSNEDC

SEQ ID NO: 559 - protein, 10 aa, Homo sapiens
TDLCNASGAH

SEQ ID NO: 560 - protein, 10 aa, Homo sapiens
VENCTQLGEQ

SEQ ID NO: 561 - protein, 10 aa, Homo sapiens
HPDPPMALSR

SEQ ID NO: 562 - protein, 10 aa, Homo sapiens
DTDPPADGPS

SEQ ID NO: 563 - protein, 10 aa, Homo sapiens
SGDPASYRLW

SEQ ID NO: 564 - protein, 10 aa, Homo sapiens
ACCSGDPASY

SEQ ID NO: 565 - protein, 10 aa, Homo sapiens
SIDTDPPADG

SEQ ID NO: 566 - protein, 10 aa, Homo sapiens
TLNPVLRHLF

SEQ ID NO: 567 - protein, 10 aa, Homo sapiens
QWEPVLVPEA

SEQ ID NO: 568 - protein, 10 aa, Homo sapiens
CATPAGPMPC

SEQ ID NO: 569 - protein, 10 aa, Homo sapiens
EAHPNASLTM

SEQ ID NO: 570 - protein, 10 aa, Homo sapiens
HLFPQEAFPA

SEQ ID NO: 571 - protein, 10 aa, Homo sapiens
VPEAHPNASL

SEQ ID NO: 572 - protein, 10 aa, Homo sapiens
WSVVSPAPSR

SEQ ID NO: 573 - protein, 10 aa, Homo sapiens
TTTWARRTSR

SEQ ID NO: 574 - protein, 10 aa, Homo sapiens
LTHPAQWEPV

SEQ ID NO: 575 - protein, 10 aa, Homo sapiens
LCCCFHGPAF

SEQ ID NO: 576 - protein, 10 aa, Homo sapiens
GVVPQASVPL

SEQ ID NO: 577 - protein, 10 aa, Homo sapiens
VLVPEAHPNA

SEQ ID NO: 578 - protein, 10 aa, Homo sapiens
ASVPLLTHPA

SEQ ID NO: 579 - protein, 10 aa, Homo sapiens
VPHPDPPMAL

SEQ ID NO: 580 - protein, 10 aa, Homo sapiens
RLPPSLRCSL

SEQ ID NO: 581 - protein, 10 aa, Homo sapiens
PADGPSNPLC

SEQ ID NO: 582 - protein, 10 aa, Homo sapiens
CCSGDPASYR

SEQ ID NO: 583 - protein, 10 aa, Homo sapiens
VVSPAPSRGQ

SEQ ID NO: 584 - protein, 10 aa, Homo sapiens
AVTPTCATPA

SEQ ID NO: 585 - protein, 10 aa, Homo sapiens
FSTLNPVLRH

SEQ ID NO: 586 - protein, 10 aa, Homo sapiens
QEAFPAHPIY

SEQ ID NO: 587 - protein, 10 aa, Homo sapiens
ATPAGPMPCS

SEQ ID NO: 588 - protein, 10 aa, Homo sapiens
EAFPAHPIYD

SEQ ID NO: 589 - protein, 10 aa, Homo sapiens
VTPTCATPAG

SEQ ID NO: 590 - protein, 10 aa, Homo sapiens
APVPHPDPPM

SEQ ID NO: 591 - protein, 10 aa, Homo sapiens
CCFHGPAFST

SEQ ID NO: 592 - protein, 10 aa, Homo sapiens
GAPLQPTLGV

SEQ ID NO: 593 - protein, 10 aa, Homo sapiens
PAHPIYDLSQ

SEQ ID NO: 594 - protein, 10 aa, Homo sapiens
CSGDPASYRL

SEQ ID NO: 595 - protein, 10 aa, Homo sapiens
AHPNASLTMY

SEQ ID NO: 596 - protein, 10 aa, Homo sapiens
STLNPVLRHL

SEQ ID NO: 597 - protein, 10 aa, Homo sapiens
RTTTWARRTS

SEQ ID NO: 598 - protein, 10 aa, Homo sapiens
GPSNPLCCCF

SEQ ID NO: 599 - protein, 10 aa, Homo sapiens
IYDLSQVWSV

SEQ ID NO: 600 - protein, 10 aa, Homo sapiens
MTHRTTTWAR

SEQ ID NO: 601 - protein, 10 aa, Homo sapiens
TPAGPMPCSR

SEQ ID NO: 602 - protein, 10 aa, Homo sapiens
RTPTRQIGSI

SEQ ID NO: 603 - protein, 10 aa, Homo sapiens
ADGPSNPLCC

SEQ ID NO: 604 - protein, 10 aa, Homo sapiens
SPAPSRGQAL

SEQ ID NO: 605 - protein, 10 aa, Homo sapiens
SRTPTRQIGS

SEQ ID NO: 606 - protein, 10 aa, Homo sapiens
WGAPLQPTLG

SEQ ID NO: 607 - protein, 10 aa, Homo sapiens
SACCSGDPAS

SEQ ID NO: 608 - protein, 10 aa, Homo sapiens
DLSQVWSVVS

SEQ ID NO: 609 - protein, 10 aa, Homo sapiens
NASLTMYVCA

SEQ ID NO: 610 - protein, 10 aa, Homo sapiens
VCAPVPHPDP

SEQ ID NO: 611 - protein, 10 aa, Homo sapiens
CCCFHGPAFS

SEQ ID NO: 612 - protein, 10 aa, Homo sapiens
VVPQASVPLL

SEQ ID NO: 613 - protein, 10 aa, Homo sapiens
TLGVVPQASV

SEQ ID NO: 614 - protein, 10 aa, Homo sapiens
SLTMYVCAPV

SEQ ID NO: 615 - protein, 10 aa, Homo sapiens
PAPSRGQALR

SEQ ID NO: 616 - protein, 10 aa, Homo sapiens
SVPLLTHPAQ

SEQ ID NO: 617 - protein, 10 aa, Homo sapiens
PSNPLCCCFH

SEQ ID NO: 618 - protein, 10 aa, Homo sapiens
VSPAPSRGQA

SEQ ID NO: 619 - protein, 10 aa, Homo sapiens
CSLHSACCSG

SEQ ID NO: 620 - protein, 10 aa, Homo sapiens
HSACCSGDPA

SEQ ID NO: 621 - protein, 10 aa, Homo sapiens
PQEAFPAHPI

SEQ ID NO: 622 - protein, 10 aa, Homo sapiens
VPQASVPLLT

SEQ ID NO: 623 - protein, 10 aa, Homo sapiens
HPNASLTMYV

SEQ ID NO: 624 - protein, 10 aa, Homo sapiens
GPMPCSRLPP

SEQ ID NO: 625 - protein, 10 aa, Homo sapiens
SNPLCCCFHG

SEQ ID NO: 626 - protein, 10 aa, Homo sapiens
NPVLRHLFPQ

SEQ ID NO: 627 - protein, 10 aa, Homo sapiens
APSRGQALRR

SEQ ID NO: 628 - protein, 10 aa, Homo sapiens
RCSLHSACCS

SEQ ID NO: 629 - protein, 10 aa, Homo sapiens
TMYVCAPVPH

SEQ ID NO: 630 - protein, 10 aa, Homo sapiens
PAGPMPCSRL

SEQ ID NO: 631 - protein, 10 aa, Homo sapiens
LVPEAHPNAS

SEQ ID NO: 632 - protein, 10 aa, Homo sapiens
SVVSPAPSRG

SEQ ID NO: 633 - protein, 10 aa, Homo sapiens
AFSTLNPVLR

SEQ ID NO: 634 - protein, 10 aa, Homo sapiens
PMALSRTPTR

SEQ ID NO: 635 - protein, 10 aa, Homo sapiens
TDPPADGPSN

SEQ ID NO: 636 - protein, 10 aa, Homo sapiens
MALSRTPTRQ

SEQ ID NO: 637 - protein, 10 aa, Homo sapiens
CSRLPPSLRC

SEQ ID NO: 638 - protein, 10 aa, Homo sapiens
HPAQWEPVLV

SEQ ID NO: 639 - protein, 10 aa, Homo sapiens
LTMYVCAPVP

SEQ ID NO: 640 - protein, 10 aa, Homo sapiens
IGSIDTDPPA

SEQ ID NO: 641 - protein, 10 aa, Homo sapiens
SRGQALRRAR

SEQ ID NO: 642 - protein, 10 aa, Homo sapiens
FHGPAFSTLN

SEQ ID NO: 643 - protein, 10 aa, Homo sapiens
RTSRAVTPTC

SEQ ID NO: 644 - protein, 10 aa, Homo sapiens
QPTLGVVPQA

SEQ ID NO: 645 - protein, 10 aa, Homo sapiens
MPCSRLPPSL

SEQ ID NO: 646 - protein, 10 aa, Homo sapiens
VPLLTHPAQW

SEQ ID NO: 647 - protein, 10 aa, Homo sapiens
LRHLFPQEAF

SEQ ID NO: 648 - protein, 10 aa, Homo sapiens
SRLPPSLRCS

SEQ ID NO: 649 - protein, 10 aa, Homo sapiens
LSQVWSVVSP

SEQ ID NO: 650 - protein, 10 aa, Homo sapiens
GSIDTDPPAD

SEQ ID NO: 651 - protein, 10 aa, Homo sapiens
ASYRLWGAPL

SEQ ID NO: 652 - protein, 10 aa, Homo sapiens
LQPTLGVVPQ

SEQ ID NO: 653 - protein, 10 aa, Homo sapiens
DPASYRLWGA

SEQ ID NO: 654 - protein, 10 aa, Homo sapiens
DGPSNPLCCC

SEQ ID NO: 655 - protein, 10 aa, Homo sapiens
GPAFSTLNPV

SEQ ID NO: 656 - protein, 10 aa, Homo sapiens
FPAHPIYDLS

SEQ ID NO: 657 - protein, 10 aa, Homo sapiens
HPIYDLSQVW

SEQ ID NO: 658 - protein, 10 aa, Homo sapiens
APLQPTLGVV

SEQ ID NO: 659 - protein, 10 aa, Homo sapiens
PTCATPAGPM

SEQ ID NO: 660 - protein, 10 aa, Homo sapiens
GDPASYRLWG

SEQ ID NO: 661 - protein, 10 aa, Homo sapiens
RLLPSLRCSL

SEQ ID NO: 662 - protein, 10 aa, Homo sapiens
LPSLRCSLHS

SEQ ID NO: 663 - protein, 10 aa, Homo sapiens
GPMPCSRLLP

SEQ ID NO: 664 - protein, 10 aa, Homo sapiens
LLPSLRCSLH

SEQ ID NO: 665 - protein, 10 aa, Homo sapiens
CSRLLPSLRC

SEQ ID NO: 666 - protein, 10 aa, Homo sapiens
MPCSRLLPSL

SEQ ID NO: 667 - protein, 10 aa, Homo sapiens
AGPMPCSRLL

SEQ ID NO: 668 - protein, 10 aa, Homo sapiens
PMPCSRLLPS

SEQ ID NO: 669 - protein, 10 aa, Homo sapiens
PCSRLLPSLR

SEQ ID NO: 670 - protein, 10 aa, Homo sapiens
SRLLPSLRCS

SEQ ID NO: 671 - protein, 10 aa, Homo sapiens
SGDPASSRLW

SEQ ID NO: 672 - protein, 10 aa, Homo sapiens
CCSGDPASSR

SEQ ID NO: 673 - protein, 10 aa, Homo sapiens
ACCSGDPASS

SEQ ID NO: 674 - protein, 10 aa, Homo sapiens
CSGDPASSRL

SEQ ID NO: 675 - protein, 10 aa, Homo sapiens
ASSRLWGAPL

SEQ ID NO: 676 - protein, 10 aa, Homo sapiens
SSRLWGAPLQ

SEQ ID NO: 677 - protein, 10 aa, Homo sapiens
DPASSRLWGA

SEQ ID NO: 678 - protein, 10 aa, Homo sapiens
GDPASSRLWG

SEQ ID NO: 679 - protein, 10 aa, Homo sapiens
SRLWGAPLQP

SEQ ID NO: 680 - protein, 10 aa, Homo sapiens
PASSRLWGAP

SEQ ID NO: 681 - protein, 10 aa, Homo sapiens
LTDPAQWEPV

SEQ ID NO: 682 - protein, 10 aa, Homo sapiens
ASVPLLTDPA

SEQ ID NO: 683 - protein, 10 aa, Homo sapiens
SVPLLTDPAQ

SEQ ID NO: 684 - protein, 10 aa, Homo sapiens
VPLLTDPAQW

SEQ ID NO: 685 - protein, 10 aa, Homo sapiens
DPAQWEPVLV

SEQ ID NO: 686 - protein, 10 aa, Homo sapiens
LLTDPAQWEP

SEQ ID NO: 687 - protein, 10 aa, Homo sapiens
TDPAQWEPVL

SEQ ID NO: 688 - protein, 10 aa, Homo sapiens
QASVPLLTDP

SEQ ID NO: 689 - protein, 10 aa, Homo sapiens
PLLTDPAQWE

SEQ ID NO: 690 - protein, 10 aa, Homo sapiens
PQASVPLLTD

SEQ ID NO: 691 - protein, 10 aa, Homo sapiens
LTDLAQWEPV

SEQ ID NO: 692 - protein, 10 aa, Homo sapiens
ASVPLLTDLA

SEQ ID NO: 693 - protein, 10 aa, Homo sapiens
SVPLLTDLAQ

SEQ ID NO: 694 - protein, 10 aa, Homo sapiens
DLAQWEPVLV

SEQ ID NO: 695 - protein, 10 aa, Homo sapiens
QASVPLLTDL

SEQ ID NO: 696 - protein, 10 aa, Homo sapiens
VPLLTDLAQW

SEQ ID NO: 697 - protein, 10 aa, Homo sapiens
LLTDLAQWEP

SEQ ID NO: 698 - protein, 10 aa, Homo sapiens
TDLAQWEPVL

SEQ ID NO: 699 - protein, 10 aa, Homo sapiens
PLLTDLAQWE

SEQ ID NO: 700 - protein, 10 aa, Homo sapiens
ASVPLLTHLA

SEQ ID NO: 701 - protein, 10 aa, Homo sapiens
SVPLLTHLAQ

SEQ ID NO: 702 - protein, 10 aa, Homo sapiens
LTHLAQWEPV

SEQ ID NO: 703 - protein, 10 aa, Homo sapiens
HLAQWEPVLV

SEQ ID NO: 704 - protein, 10 aa, Homo sapiens
QASVPLLTHL

SEQ ID NO: 705 - protein, 10 aa, Homo sapiens
LAQWEPVLVP

SEQ ID NO: 706 - protein, 10 aa, Homo sapiens
VPLLTHLAQW

SEQ ID NO: 707 - protein, 10 aa, Homo sapiens
LLTHLAQWEP

SEQ ID NO: 708 - protein, 10 aa, Homo sapiens
THLAQWEPVL

SEQ ID NO: 709 - protein, 10 aa, Homo sapiens
PLLTHLAQWE

SEQ ID NO: 710 - protein, 10 aa, Homo sapiens
TPVPHPDPPM

SEQ ID NO: 711 - protein, 10 aa, Homo sapiens
NASLTMYVCT

SEQ ID NO: 712 - protein, 10 aa, Homo sapiens
VCTPVPHPDP

SEQ ID NO: 713 - protein, 10 aa, Homo sapiens
TMYVCTPVPH

SEQ ID NO: 714 - protein, 10 aa, Homo sapiens
SLTMYVCTPV

SEQ ID NO: 715 - protein, 10 aa, Homo sapiens
LTMYVCTPVP

SEQ ID NO: 716 - protein, 10 aa, Homo sapiens
CTPVPHPDPP

SEQ ID NO: 717 - protein, 10 aa, Homo sapiens
ASLTMYVCTP

SEQ ID NO: 718 - protein, 10 aa, Homo sapiens
YVCTPVPHPD

SEQ ID NO: 719 - protein, 10 aa, Homo sapiens
MYVCTPVPHP

SEQ ID NO: 720 - protein, 10 aa, Homo sapiens
ISSIDTDPPA

SEQ ID NO: 721 - protein, 10 aa, Homo sapiens
SRTPTRQISS

SEQ ID NO: 722 - protein, 10 aa, Homo sapiens
RTPTRQISSI

SEQ ID NO: 723 - protein, 10 aa, Homo sapiens
SSIDTDPPAD

SEQ ID NO: 724 - protein, 10 aa, Homo sapiens
LSRTPTRQIS

SEQ ID NO: 725 - protein, 10 aa, Homo sapiens
PTRQISSIDT

SEQ ID NO: 726 - protein, 10 aa, Homo sapiens
QISSIDTDPP

SEQ ID NO: 727 - protein, 10 aa, Homo sapiens
RQISSIDTDP

SEQ ID NO: 728 - protein, 10 aa, Homo sapiens
TRQISSIDTD

SEQ ID NO: 729 - protein, 10 aa, Homo sapiens
TPTRQISSID

SEQ ID NO: 730 - protein, 10 aa, Homo sapiens
ISSIDTDPPA

SEQ ID NO: 731 - protein, 10 aa, Homo sapiens
SRTPTRQISS

SEQ ID NO: 732 - protein, 10 aa, Homo sapiens
RTPTRQISSI

SEQ ID NO: 733 - protein, 10 aa, Homo sapiens
SSIDTDPPAD

SEQ ID NO: 734 - protein, 10 aa, Homo sapiens
LSRTPTRQIS

SEQ ID NO: 735 - protein, 10 aa, Homo sapiens
PTRQISSIDT

SEQ ID NO: 736 - protein, 10 aa, Homo sapiens
QISSIDTDPP

SEQ ID NO: 737 - protein, 10 aa, Homo sapiens
RQISSIDTDP

SEQ ID NO: 738 - protein, 10 aa, Homo sapiens
TRQISSIDTD

SEQ ID NO: 739 - protein, 10 aa, Homo sapiens
TPTRQISSID

SEQ ID NO: 740 - protein, 10 aa, Homo sapiens
SSDTDPPADG

SEQ ID NO: 741 - protein, 10 aa, Homo sapiens
RTPTRQIGSS

SEQ ID NO: 742 - protein, 10 aa, Homo sapiens
IGSSDTDPPA

SEQ ID NO: 743 - protein, 10 aa, Homo sapiens
GSSDTDPPAD

SEQ ID NO: 744 - protein, 10 aa, Homo sapiens
QIGSSDTDPP

SEQ ID NO: 745 - protein, 10 aa, Homo sapiens
PTRQIGSSDT

SEQ ID NO: 746 - protein, 10 aa, Homo sapiens
RQIGSSDTDP

SEQ ID NO: 747 - protein, 10 aa, Homo sapiens
TRQIGSSDTD

SEQ ID NO: 748 - protein, 10 aa, Homo sapiens
SDTDPPADGP

SEQ ID NO: 749 - protein, 10 aa, Homo sapiens
TPTRQIGSSD

SEQ ID NO: 750 - protein, 10 aa, Homo sapiens
SRGQALRRAQ

SEQ ID NO: 751 - protein, 10 aa, Homo sapiens
PSRGQALRRA

SEQ ID NO: 752 - protein, 9 aa, Homo sapiens
QLGEQCWTA

SEQ ID NO: 753 - protein, 9 aa, Homo sapiens
LLALLMAGL

SEQ ID NO: 754 - protein, 9 aa, Homo sapiens
ALLMAGLAL

SEQ ID NO: 755 - protein, 9 aa, Homo sapiens
LLPALGLLL

SEQ ID NO: 756 - protein, 9 aa, Homo sapiens
AILALLPAL

SEQ ID NO: 757 - protein, 9 aa, Homo sapiens
ALLPALGLL

SEQ ID NO: 758 - protein, 9 aa, Homo sapiens
ALQPGTALL

SEQ ID NO: 759 - protein, 9 aa, Homo sapiens
ALLCYSCKA

SEQ ID NO: 760 - protein, 9 aa, Homo sapiens
LLLWGPGQL

SEQ ID NO: 761 - protein, 9 aa, Homo sapiens
TQLGEQCWT

SEQ ID NO: 762 - protein, 9 aa, Homo sapiens
LQVENCTQL

SEQ ID NO: 763 - protein, 9 aa, Homo sapiens
ALQPAAAIL

SEQ ID NO: 764 - protein, 9 aa, Homo sapiens
LLTVISKGC

SEQ ID NO: 765 - protein, 9 aa, Homo sapiens
AVLLALLMA

SEQ ID NO: 766 - protein, 9 aa, Homo sapiens
VSNEDCLQV

SEQ ID NO: 767 - protein, 9 aa, Homo sapiens
NITCCDTDL

SEQ ID NO: 768 - protein, 9 aa, Homo sapiens
LCYSCKAQV

SEQ ID NO: 769 - protein, 9 aa, Homo sapiens
YVGKKNITC

SEQ ID NO: 770 - protein, 9 aa, Homo sapiens
TVISKGCSL

SEQ ID NO: 771 - protein, 9 aa, Homo sapiens
LALLPALGL

SEQ ID NO: 772 - protein, 9 aa, Homo sapiens
LALQPGTAL

SEQ ID NO: 773 - protein, 9 aa, Homo sapiens
VLLALLMAG

SEQ ID NO: 774 - protein, 9 aa, Homo sapiens
AQVSNEDCL

SEQ ID NO: 775 - protein, 9 aa, Homo sapiens
LQPGTALLC

SEQ ID NO: 776 - protein, 9 aa, Homo sapiens
LQPAAAILA

SEQ ID NO: 777 - protein, 9 aa, Homo sapiens
GLALQPGTA

SEQ ID NO: 778 - protein, 9 aa, Homo sapiens
GLLTVISKG

SEQ ID NO: 779 - protein, 9 aa, Homo sapiens
VDDSQDYYV

SEQ ID NO: 780 - protein, 9 aa, Homo sapiens
QPAAAILAL

SEQ ID NO: 781 - protein, 9 aa, Homo sapiens
QCWTARIRA

SEQ ID NO: 782 - protein, 9 aa, Homo sapiens
ALGLLLWGP

SEQ ID NO: 783 - protein, 9 aa, Homo sapiens
KAVLLALLM

SEQ ID NO: 784 - protein, 9 aa, Homo sapiens
SKGCSLNCV

SEQ ID NO: 785 - protein, 9 aa, Homo sapiens
LLMAGLALQ

SEQ ID NO: 786 - protein, 9 aa, Homo sapiens
GEQCWTARI

SEQ ID NO: 787 - protein, 9 aa, Homo sapiens
AGLALQPGT

SEQ ID NO: 788 - protein, 9 aa, Homo sapiens
AAILALLPA

SEQ ID NO: 789 - protein, 9 aa, Homo sapiens
CNASGAHAL

SEQ ID NO: 790 - protein, 9 aa, Homo sapiens
RAVGLLTVI

SEQ ID NO: 791 - protein, 9 aa, Homo sapiens
ILALLPALG

SEQ ID NO: 792 - protein, 9 aa, Homo sapiens
KAQVSNEDC

SEQ ID NO: 793 - protein, 9 aa, Homo sapiens
MKAVLLALL

SEQ ID NO: 794 - protein, 9 aa, Homo sapiens
RIRAVGLLT

SEQ ID NO: 795 - protein, 9 aa, Homo sapiens
SGAHALQPA

SEQ ID NO: 796 - protein, 9 aa, Homo sapiens
GTALLCYSC

SEQ ID NO: 797 - protein, 9 aa, Homo sapiens
GAHALQPAA

SEQ ID NO: 798 - protein, 9 aa, Homo sapiens
ITCCDTDLC

SEQ ID NO: 799 - protein, 9 aa, Homo sapiens
LALLMAGLA

SEQ ID NO: 800 - protein, 9 aa, Homo sapiens
GLLLWGPGQ

SEQ ID NO: 801 - protein, 9 aa, Homo sapiens
LCNASGAHA

SEQ ID NO: 802 - protein, 9 aa, Homo sapiens
IRAVGLLTV

SEQ ID NO: 803 - protein, 9 aa, Homo sapiens
KKNITCCDT

SEQ ID NO: 804 - protein, 9 aa, Homo sapiens
CCDTDLCNA

SEQ ID NO: 805 - protein, 9 aa, Homo sapiens
CVDDSQDYY

SEQ ID NO: 806 - protein, 9 aa, Homo sapiens
TDLCNASGA

SEQ ID NO: 807 - protein, 9 aa, Homo sapiens
LLCYSCKAQ

SEQ ID NO: 808 - protein, 9 aa, Homo sapiens
TARIRAVGL

SEQ ID NO: 809 - protein, 9 aa, Homo sapiens
LMAGLALQP

SEQ ID NO: 810 - protein, 9 aa, Homo sapiens
HALQPAAAI

SEQ ID NO: 811 - protein, 9 aa, Homo sapiens
VISKGCSLN

SEQ ID NO: 812 - protein, 9 aa, Homo sapiens
NCTQLGEQC

SEQ ID NO: 813 - protein, 9 aa, Homo sapiens
PAAAILALL

SEQ ID NO: 814 - protein, 9 aa, Homo sapiens
CLQVENCTQ

SEQ ID NO: 815 - protein, 9 aa, Homo sapiens
DCLQVENCT

SEQ ID NO: 816 - protein, 9 aa, Homo sapiens
SLNCVDDSQ

SEQ ID NO: 817 - protein, 9 aa, Homo sapiens
CWTARIRAV

SEQ ID NO: 818 - protein, 9 aa, Homo sapiens
VGKKNITCC

SEQ ID NO: 819 - protein, 9 aa, Homo sapiens
MAGLALQPG

SEQ ID NO: 820 - protein, 9 aa, Homo sapiens
AHALQPAAA

SEQ ID NO: 821 - protein, 9 aa, Homo sapiens
AVGLLTVIS

SEQ ID NO: 822 - protein, 9 aa, Homo sapiens
YSCKAQVSN

SEQ ID NO: 823 - protein, 9 aa, Homo sapiens
CSLNCVDDS

SEQ ID NO: 824 - protein, 9 aa, Homo sapiens
TCCDTDLCN

SEQ ID NO: 825 - protein, 9 aa, Homo sapiens
NCVDDSQDY

SEQ ID NO: 826 - protein, 9 aa, Homo sapiens
WTARIRAVG

SEQ ID NO: 827 - protein, 9 aa, Homo sapiens
YYVGKKNIT

SEQ ID NO: 828 - protein, 9 aa, Homo sapiens
ISKGCSLNC

SEQ ID NO: 829 - protein, 9 aa, Homo sapiens
LPALGLLLW

SEQ ID NO: 830 - protein, 9 aa, Homo sapiens
VGLLTVISK

SEQ ID NO: 831 - protein, 9 aa, Homo sapiens
QVSNEDCLQ

SEQ ID NO: 832 - protein, 9 aa, Homo sapiens
TALLCYSCK

SEQ ID NO: 833 - protein, 9 aa, Homo sapiens
QPGTALLCY

SEQ ID NO: 834 - protein, 9 aa, Homo sapiens
PALGLLLWG

SEQ ID NO: 835 - protein, 9 aa, Homo sapiens
CTQLGEQCW

SEQ ID NO: 836 - protein, 9 aa, Homo sapiens
ARIRAVGLL

SEQ ID NO: 837 - protein, 9 aa, Homo sapiens
DLCNASGAH

SEQ ID NO: 838 - protein, 9 aa, Homo sapiens
LGLLLWGPG

SEQ ID NO: 839 - protein, 9 aa, Homo sapiens
EDCLQVENC

SEQ ID NO: 840 - protein, 9 aa, Homo sapiens
NEDCLQVEN

SEQ ID NO: 841 - protein, 9 aa, Homo sapiens
VENCTQLGE

SEQ ID NO: 842 - protein, 9 aa, Homo sapiens
CDTDLCNAS

SEQ ID NO: 843 - protein, 9 aa, Homo sapiens
QVENCTQLG

SEQ ID NO: 844 - protein, 9 aa, Homo sapiens
DYYVGKKNI

SEQ ID NO: 845 - protein, 9 aa, Homo sapiens
QDYYVGKKN

SEQ ID NO: 846 - protein, 9 aa, Homo sapiens
LTVISKGCS

SEQ ID NO: 847 - protein, 9 aa, Homo sapiens
AAAILALLP

SEQ ID NO: 848 - protein, 9 aa, Homo sapiens
NASGAHALQ

SEQ ID NO: 849 - protein, 9 aa, Homo sapiens
SQDYYVGKK

SEQ ID NO: 850 - protein, 9 aa, Homo sapiens
KNITCCDTD

SEQ ID NO: 851 - protein, 9 aa, Homo sapiens
LNCVDDSQD

SEQ ID NO: 852 - protein, 9 aa, Homo sapiens
YDLSQVWSV

SEQ ID NO: 853 - protein, 9 aa, Homo sapiens
TLNPVLRHL

SEQ ID NO: 854 - protein, 9 aa, Homo sapiens
QVWSVVSPA

SEQ ID NO: 855 - protein, 9 aa, Homo sapiens
LTMYVCAPV

SEQ ID NO: 856 - protein, 9 aa, Homo sapiens
DLSQVWSVV

SEQ ID NO: 857 - protein, 9 aa, Homo sapiens
VVPQASVPL

SEQ ID NO: 858 - protein, 9 aa, Homo sapiens
LVPEAHPNA

SEQ ID NO: 859 - protein, 9 aa, Homo sapiens
APLQPTLGV

SEQ ID NO: 860 - protein, 9 aa, Homo sapiens
FPAHPIYDL

SEQ ID NO: 861 - protein, 9 aa, Homo sapiens
WEPVLVPEA

SEQ ID NO: 862 - protein, 9 aa, Homo sapiens
SLRCSLHSA

SEQ ID NO: 863 - protein, 9 aa, Homo sapiens
LGVVPQASV

SEQ ID NO: 864 - protein, 9 aa, Homo sapiens
MTHRTTTWA

SEQ ID NO: 865 - protein, 9 aa, Homo sapiens
WGAPLQPTL

SEQ ID NO: 866 - protein, 9 aa, Homo sapiens
VPQASVPLL

SEQ ID NO: 867 - protein, 9 aa, Homo sapiens
SVPLLTHPA

SEQ ID NO: 868 - protein, 9 aa, Homo sapiens
RTSRAVTPT

SEQ ID NO: 869 - protein, 9 aa, Homo sapiens
LPPSLRCSL

SEQ ID NO: 870 - protein, 9 aa, Homo sapiens
QEAFPAHPI

SEQ ID NO: 871 - protein, 9 aa, Homo sapiens
PLQPTLGVV

SEQ ID NO: 872 - protein, 9 aa, Homo sapiens
PAFSTLNPV

SEQ ID NO: 873 - protein, 9 aa, Homo sapiens
ASLTMYVCA

SEQ ID NO: 874 - protein, 9 aa, Homo sapiens
AGPMPCSRL

SEQ ID NO: 875 - protein, 9 aa, Homo sapiens
LLTHPAQWE

SEQ ID NO: 876 - protein, 9 aa, Homo sapiens
GSIDTDPPA

SEQ ID NO: 877 - protein, 9 aa, Homo sapiens
FHGPAFSTL

SEQ ID NO: 878 - protein, 9 aa, Homo sapiens
VLVPEAHPN

SEQ ID NO: 879 - protein, 9 aa, Homo sapiens
RLWGAPLQP

SEQ ID NO: 880 - protein, 9 aa, Homo sapiens
PMALSRTPT

SEQ ID NO: 881 - protein, 9 aa, Homo sapiens
VTPTCATPA

SEQ ID NO: 882 - protein, 9 aa, Homo sapiens
RAVTPTCAT

SEQ ID NO: 883 - protein, 9 aa, Homo sapiens
GPSNPLCCC

SEQ ID NO: 884 - protein, 9 aa, Homo sapiens
TLGVVPQAS

SEQ ID NO: 885 - protein, 9 aa, Homo sapiens
SLHSACCSG

SEQ ID NO: 886 - protein, 9 aa, Homo sapiens
ATPAGPMPC

SEQ ID NO: 887 - protein, 9 aa, Homo sapiens
WARRTSRAV

SEQ ID NO: 888 - protein, 9 aa, Homo sapiens
NASLTMYVC

SEQ ID NO: 889 - protein, 9 aa, Homo sapiens
SGDPASYRL

SEQ ID NO: 890 - protein, 9 aa, Homo sapiens
VPHPDPPMA

SEQ ID NO: 891 - protein, 9 aa, Homo sapiens
PNASLTMYV

SEQ ID NO: 892 - protein, 9 aa, Homo sapiens
AQWEPVLVP

SEQ ID NO: 893 - protein, 9 aa, Homo sapiens
THPAQWEPV

SEQ ID NO: 894 - protein, 9 aa, Homo sapiens
HPIYDLSQV

SEQ ID NO: 895 - protein, 9 aa, Homo sapiens
SLTMYVCAP

SEQ ID NO: 896 - protein, 9 aa, Homo sapiens
RLPPSLRCS

SEQ ID NO: 897 - protein, 9 aa, Homo sapiens
LFPQEAFPA

SEQ ID NO: 898 - protein, 9 aa, Homo sapiens
SACCSGDPA

SEQ ID NO: 899 - protein, 9 aa, Homo sapiens
RCSLHSACC

SEQ ID NO: 900 - protein, 9 aa, Homo sapiens
CFHGPAFST

SEQ ID NO: 901 - protein, 9 aa, Homo sapiens
LCCCFHGPA

SEQ ID NO: 902 - protein, 9 aa, Homo sapiens
PASYRLWGA

SEQ ID NO: 903 - protein, 9 aa, Homo sapiens
PAQWEPVLV

SEQ ID NO: 904 - protein, 9 aa, Homo sapiens
RTTTWARRT

SEQ ID NO: 905 - protein, 9 aa, Homo sapiens
TPTRQIGSI

SEQ ID NO: 906 - protein, 9 aa, Homo sapiens
FPQEAFPAH

SEQ ID NO: 907 - protein, 9 aa, Homo sapiens
PQASVPLLT

SEQ ID NO: 908 - protein, 9 aa, Homo sapiens
ALSRTPTRQ

SEQ ID NO: 909 - protein, 9 aa, Homo sapiens
TMYVCAPVP

SEQ ID NO: 910 - protein, 9 aa, Homo sapiens
YVCAPVPHP

SEQ ID NO: 911 - protein, 9 aa, Homo sapiens
PTLGVVPQA

SEQ ID NO: 912 - protein, 9 aa, Homo sapiens
VVSPAPSRG

SEQ ID NO: 913 - protein, 9 aa, Homo sapiens
NPLCCCFHG

SEQ ID NO: 914 - protein, 9 aa, Homo sapiens
HLFPQEAFP

SEQ ID NO: 915 - protein, 9 aa, Homo sapiens
CCFHGPAFS

SEQ ID NO: 916 - protein, 9 aa, Homo sapiens
PVPHPDPPM

SEQ ID NO: 917 - protein, 9 aa, Homo sapiens
PEAHPNASL

SEQ ID NO: 918 - protein, 9 aa, Homo sapiens
STLNPVLRH

SEQ ID NO: 919 - protein, 9 aa, Homo sapiens
DPPMALSRT

SEQ ID NO: 920 - protein, 9 aa, Homo sapiens
EAHPNASLT

SEQ ID NO: 921 - protein, 9 aa, Homo sapiens
ADGPSNPLC

SEQ ID NO: 922 - protein, 9 aa, Homo sapiens
PAPSRGQAL

SEQ ID NO: 923 - protein, 9 aa, Homo sapiens
AFSTLNPVL

SEQ ID NO: 924 - protein, 9 aa, Homo sapiens
PLLTHPAQW

SEQ ID NO: 925 - protein, 9 aa, Homo sapiens
LRHLFPQEA

SEQ ID NO: 926 - protein, 9 aa, Homo sapiens
SPAPSRGQA

SEQ ID NO: 927 - protein, 9 aa, Homo sapiens
TCATPAGPM

SEQ ID NO: 928 - protein, 9 aa, Homo sapiens
LWGAPLQPT

SEQ ID NO: 929 - protein, 9 aa, Homo sapiens
VLRHLFPQE

SEQ ID NO: 930 - protein, 9 aa, Homo sapiens
SQVWSVVSP

SEQ ID NO: 931 - protein, 9 aa, Homo sapiens
AHPNASLTM

SEQ ID NO: 932 - protein, 9 aa, Homo sapiens
PCSRLPPSL

SEQ ID NO: 933 - protein, 9 aa, Homo sapiens
SNPLCCCFH

SEQ ID NO: 934 - protein, 9 aa, Homo sapiens
LTHPAQWEP

SEQ ID NO: 935 - protein, 9 aa, Homo sapiens
PADGPSNPL

SEQ ID NO: 936 - protein, 9 aa, Homo sapiens
SRLPPSLRC

SEQ ID NO: 937 - protein, 9 aa, Homo sapiens
TSRAVTPTC

SEQ ID NO: 938 - protein, 9 aa, Homo sapiens
DGPSNPLCC

SEQ ID NO: 939 - protein, 9 aa, Homo sapiens
QASVPLLTH

SEQ ID NO: 940 - protein, 9 aa, Homo sapiens
WSVVSPAPS

SEQ ID NO: 941 - protein, 9 aa, Homo sapiens
CSGDPASYR

SEQ ID NO: 942 - protein, 9 aa, Homo sapiens
QIGSIDTDP

SEQ ID NO: 943 - protein, 9 aa, Homo sapiens
HPAQWEPVL

SEQ ID NO: 944 - protein, 9 aa, Homo sapiens
MPCSRLPPS

SEQ ID NO: 945 - protein, 9 aa, Homo sapiens
CSLHSACCS

SEQ ID NO: 946 - protein, 9 aa, Homo sapiens
LSRTPTRQI

SEQ ID NO: 947 - protein, 9 aa, Homo sapiens
TTWARRTSR

SEQ ID NO: 948 - protein, 9 aa, Homo sapiens
RQIGSIDTD

SEQ ID NO: 949 - protein, 9 aa, Homo sapiens
PVLRHLFPQ

SEQ ID NO: 950 - protein, 9 aa, Homo sapiens
PHPDPPMAL

SEQ ID NO: 951 - protein, 9 aa, Homo sapiens
SVVSPAPSR

SEQ ID NO: 952 - protein, 9 aa, Homo sapiens
LLPSLRCSL

SEQ ID NO: 953 - protein, 9 aa, Homo sapiens
RLLPSLRCS

SEQ ID NO: 954 - protein, 9 aa, Homo sapiens
GPMPCSRLL

SEQ ID NO: 955 - protein, 9 aa, Homo sapiens
PCSRLLPSL

SEQ ID NO: 956 - protein, 9 aa, Homo sapiens
SRLLPSLRC

SEQ ID NO: 957 - protein, 9 aa, Homo sapiens
MPCSRLLPS

SEQ ID NO: 958 - protein, 9 aa, Homo sapiens
LPSLRCSLH

SEQ ID NO: 959 - protein, 9 aa, Homo sapiens
PMPCSRLLP

SEQ ID NO: 960 - protein, 9 aa, Homo sapiens
CSRLLPSLR

SEQ ID NO: 961 - protein, 9 aa, Homo sapiens
SGDPASSRL

SEQ ID NO: 962 - protein, 9 aa, Homo sapiens
PASSRLWGA

SEQ ID NO: 963 - protein, 9 aa, Homo sapiens
SSRLWGAPL

SEQ ID NO: 964 - protein, 9 aa, Homo sapiens
CCSGDPASS

SEQ ID NO: 965 - protein, 9 aa, Homo sapiens
CSGDPASSR

SEQ ID NO: 966 - protein, 9 aa, Homo sapiens
DPASSRLWG

SEQ ID NO: 967 - protein, 9 aa, Homo sapiens
ASSRLWGAP

SEQ ID NO: 968 - protein, 9 aa, Homo sapiens
GDPASSRLW

SEQ ID NO: 969 - protein, 9 aa, Homo sapiens
SRLWGAPLQ

SEQ ID NO: 970 - protein, 9 aa, Homo sapiens
LLTDPAQWE

SEQ ID NO: 971 - protein, 9 aa, Homo sapiens
SVPLLTDPA

SEQ ID NO: 972 - protein, 9 aa, Homo sapiens
TDPAQWEPV

SEQ ID NO: 973 - protein, 9 aa, Homo sapiens
PLLTDPAQW

SEQ ID NO: 974 - protein, 9 aa, Homo sapiens
DPAQWEPVL

SEQ ID NO: 975 - protein, 9 aa, Homo sapiens
LTDPAQWEP

SEQ ID NO: 976 - protein, 9 aa, Homo sapiens
VPLLTDPAQ

SEQ ID NO: 977 - protein, 9 aa, Homo sapiens
QASVPLLTD

SEQ ID NO: 978 - protein, 9 aa, Homo sapiens
ASVPLLTDP

SEQ ID NO: 979 - protein, 9 aa, Homo sapiens
DLAQWEPVL

SEQ ID NO: 980 - protein, 9 aa, Homo sapiens
LLTDLAQWE

SEQ ID NO: 981 - protein, 9 aa, Homo sapiens
ASVPLLTDL

SEQ ID NO: 982 - protein, 9 aa, Homo sapiens
TDLAQWEPV

SEQ ID NO: 983 - protein, 9 aa, Homo sapiens
SVPLLTDLA

SEQ ID NO: 984 - protein, 9 aa, Homo sapiens
PLLTDLAQW

SEQ ID NO: 985 - protein, 9 aa, Homo sapiens
LTDLAQWEP

SEQ ID NO: 986 - protein, 9 aa, Homo sapiens
VPLLTDLAQ

SEQ ID NO: 987 - protein, 9 aa, Homo sapiens
LAQWEPVLV

SEQ ID NO: 988 - protein, 9 aa, Homo sapiens
SVPLLTHLA

SEQ ID NO: 989 - protein, 9 aa, Homo sapiens
ASVPLLTHL

SEQ ID NO: 990 - protein, 9 aa, Homo sapiens
HLAQWEPVL

SEQ ID NO: 991 - protein, 9 aa, Homo sapiens
THLAQWEPV

SEQ ID NO: 992 - protein, 9 aa, Homo sapiens
LLTHLAQWE

SEQ ID NO: 993 - protein, 9 aa, Homo sapiens
PLLTHLAQW

SEQ ID NO: 994 - protein, 9 aa, Homo sapiens
LTHLAQWEP

SEQ ID NO: 995 - protein, 9 aa, Homo sapiens
VPLLTHLAQ

SEQ ID NO: 996 - protein, 9 aa, Homo sapiens
LTMYVCTPV

SEQ ID NO: 997 - protein, 9 aa, Homo sapiens
ASLTMYVCT

SEQ ID NO: 998 - protein, 9 aa, Homo sapiens
SLTMYVCTP

SEQ ID NO: 999 - protein, 9 aa, Homo sapiens
TMYVCTPVP

SEQ ID NO: 1000 - protein, 9 aa, Homo sapiens
YVCTPVPHP

SEQ ID NO: 1001 - protein, 9 aa, Homo sapiens
CTPVPHPDP

SEQ ID NO: 1002 - protein, 9 aa, Homo sapiens
VCTPVPHPD

SEQ ID NO: 1003 - protein, 9 aa, Homo sapiens
MYVCTPVPH

SEQ ID NO: 1004 - protein, 9 aa, Homo sapiens
TPTRQISSI

SEQ ID NO: 1005 - protein, 9 aa, Homo sapiens
SSIDTDPPA

SEQ ID NO: 1006 - protein, 9 aa, Homo sapiens
QISSIDTDP

SEQ ID NO: 1007 - protein, 9 aa, Homo sapiens
RQISSIDTD

SEQ ID NO: 1008 - protein, 9 aa, Homo sapiens
TRQISSIDT

SEQ ID NO: 1009 - protein, 9 aa, Homo sapiens
RTPTRQISS

SEQ ID NO: 1010 - protein, 9 aa, Homo sapiens
ISSIDTDPP

SEQ ID NO: 1011 - protein, 9 aa, Homo sapiens
SRTPTRQIS

SEQ ID NO: 1012 - protein, 9 aa, Homo sapiens
PTRQISSID

SEQ ID NO: 1013 - protein, 9 aa, Homo sapiens
SSSDTDPPA

SEQ ID NO: 1014 - protein, 9 aa, Homo sapiens
QISSSDTDP

SEQ ID NO: 1015 - protein, 9 aa, Homo sapiens
TPTRQISSS

SEQ ID NO: 1016 - protein, 9 aa, Homo sapiens
TRQISSSDT

SEQ ID NO: 1017 - protein, 9 aa, Homo sapiens
RQISSSDTD

SEQ ID NO: 1018 - protein, 9 aa, Homo sapiens
ISSSDTDPP

SEQ ID NO: 1019 - protein, 9 aa, Homo sapiens
PTRQISSSD

SEQ ID NO: 1020 - protein, 9 aa, Homo sapiens
GSSDTDPPA

SEQ ID NO: 1021 - protein, 9 aa, Homo sapiens
QIGSSDTDP

SEQ ID NO: 1022 - protein, 9 aa, Homo sapiens
TRQIGSSDT

SEQ ID NO: 1023 - protein, 9 aa, Homo sapiens
RQIGSSDTD

SEQ ID NO: 1024 - protein, 9 aa, Homo sapiens
SDTDPPADG

SEQ ID NO: 1025 - protein, 9 aa, Homo sapiens
TPTRQIGSS

SEQ ID NO: 1026 - protein, 9 aa, Homo sapiens
IGSSDTDPP

SEQ ID NO: 1027 - protein, 9 aa, Homo sapiens
SSDTDPPAD

SEQ ID NO: 1028 - protein, 9 aa, Homo sapiens
PTRQIGSSD

SEQ ID NO: 1029 - protein, 9 aa, Homo sapiens
SRGQALRRA

SEQ ID NO: 1030 - protein, 9 aa, Homo sapiens
RGQALRRAQ

SEQ ID NO: 1031 - protein, 10 aa, Homo sapiens
VLLALLMAGL

SEQ ID NO: 1032 - protein, 10 aa, Homo sapiens
LLCYSCKAQV

SEQ ID NO: 1033 - protein, 10 aa, Homo sapiens
ALLPALGLLL

SEQ ID NO: 1034 - protein, 10 aa, Homo sapiens
CVDDSQDYYV

SEQ ID NO: 1035 - protein, 10 aa, Homo sapiens
ILALLPALGL

SEQ ID NO: 1036 - protein, 10 aa, Homo sapiens
CLQVENCTQL

SEQ ID NO: 1037 - protein, 10 aa, Homo sapiens
GLALQPGTAL

SEQ ID NO: 1038 - protein, 10 aa, Homo sapiens
GLLTVISKGC

SEQ ID NO: 1039 - protein, 10 aa, Homo sapiens
TQLGEQCWTA

SEQ ID NO: 1040 - protein, 10 aa, Homo sapiens
GLLLWGPGQL

SEQ ID NO: 1041 - protein, 10 aa, Homo sapiens
LQPAAAILAL

SEQ ID NO: 1042 - protein, 10 aa, Homo sapiens
QVSNEDCLQV

SEQ ID NO: 1043 - protein, 10 aa, Homo sapiens
ALQPAAAILA

SEQ ID NO: 1044 - protein, 10 aa, Homo sapiens
ALQPGTALLC

SEQ ID NO: 1045 - protein, 10 aa, Homo sapiens
YVGKKNITCC

SEQ ID NO: 1046 - protein, 10 aa, Homo sapiens
LALLMAGLAL

SEQ ID NO: 1047 - protein, 10 aa, Homo sapiens
LALQPGTALL

SEQ ID NO: 1048 - protein, 10 aa, Homo sapiens
QCWTARIRAV

SEQ ID NO: 1049 - protein, 10 aa, Homo sapiens
RIRAVGLLTV

SEQ ID NO: 1050 - protein, 10 aa, Homo sapiens
WTARIRAVGL

SEQ ID NO: 1051 - protein, 10 aa, Homo sapiens
VISKGCSLNC

SEQ ID NO: 1052 - protein, 10 aa, Homo sapiens
LLALLMAGLA

SEQ ID NO: 1053 - protein, 10 aa, Homo sapiens
AAILALLPAL

SEQ ID NO: 1054 - protein, 10 aa, Homo sapiens
CTQLGEQCWT

SEQ ID NO: 1055 - protein, 10 aa, Homo sapiens
LALLPALGLL

SEQ ID NO: 1056 - protein, 10 aa, Homo sapiens
KAVLLALLMA

SEQ ID NO: 1057 - protein, 10 aa, Homo sapiens
KAQVSNEDCL

SEQ ID NO: 1058 - protein, 10 aa, Homo sapiens
LTVISKGCSL

SEQ ID NO: 1059 - protein, 10 aa, Homo sapiens
KNITCCDTDL

SEQ ID NO: 1060 - protein, 10 aa, Homo sapiens
DLCNASGAHA

SEQ ID NO: 1061 - protein, 10 aa, Homo sapiens
NITCCDTDLC

SEQ ID NO: 1062 - protein, 10 aa, Homo sapiens
QPAAAILALL

SEQ ID NO: 1063 - protein, 10 aa, Homo sapiens
TCCDTDLCNA

SEQ ID NO: 1064 - protein, 10 aa, Homo sapiens
LLPALGLLLW

SEQ ID NO: 1065 - protein, 10 aa, Homo sapiens
TALLCYSCKA

SEQ ID NO: 1066 - protein, 10 aa, Homo sapiens
LCNASGAHAL

SEQ ID NO: 1067 - protein, 10 aa, Homo sapiens
LMAGLALQPG

SEQ ID NO: 1068 - protein, 10 aa, Homo sapiens
MAGLALQPGT

SEQ ID NO: 1069 - protein, 10 aa, Homo sapiens
AAAILALLPA

SEQ ID NO: 1070 - protein, 10 aa, Homo sapiens
ALLMAGLALQ

SEQ ID NO: 1071 - protein, 10 aa, Homo sapiens
QLGEQCWTAR

SEQ ID NO: 1072 - protein, 10 aa, Homo sapiens
LLMAGLALQP

SEQ ID NO: 1073 - protein, 10 aa, Homo sapiens
ASGAHALQPA

SEQ ID NO: 1074 - protein, 10 aa, Homo sapiens
GAHALQPAAA

SEQ ID NO: 1075 - protein, 10 aa, Homo sapiens
ISKGCSLNCV

SEQ ID NO: 1076 - protein, 10 aa, Homo sapiens
AVLLALLMAG

SEQ ID NO: 1077 - protein, 10 aa, Homo sapiens
ALLCYSCKAQ

SEQ ID NO: 1078 - protein, 10 aa, Homo sapiens
LQVENCTQLG

SEQ ID NO: 1079 - protein, 10 aa, Homo sapiens
QDYYVGKKNI

SEQ ID NO: 1080 - protein, 10 aa, Homo sapiens
NEDCLQVENC

SEQ ID NO: 1081 - protein, 10 aa, Homo sapiens
AILALLPALG

SEQ ID NO: 1082 - protein, 10 aa, Homo sapiens
EQCWTARIRA

SEQ ID NO: 1083 - protein, 10 aa, Homo sapiens
SGAHALQPAA

SEQ ID NO: 1084 - protein, 10 aa, Homo sapiens
LQPGTALLCY

SEQ ID NO: 1085 - protein, 10 aa, Homo sapiens
ALGLLLWGPG

SEQ ID NO: 1086 - protein, 10 aa, Homo sapiens
LLTVISKGCS

SEQ ID NO: 1087 - protein, 10 aa, Homo sapiens
AGLALQPGTA

SEQ ID NO: 1088 - protein, 10 aa, Homo sapiens
HALQPAAAIL

SEQ ID NO: 1089 - protein, 10 aa, Homo sapiens
SLNCVDDSQD

SEQ ID NO: 1090 - protein, 10 aa, Homo sapiens
MKAVLLALLM

SEQ ID NO: 1091 - protein, 10 aa, Homo sapiens
LPALGLLLWG

SEQ ID NO: 1092 - protein, 10 aa, Homo sapiens
LGEQCWTARI

SEQ ID NO: 1093 - protein, 10 aa, Homo sapiens
AHALQPAAAI

SEQ ID NO: 1094 - protein, 10 aa, Homo sapiens
VGLLTVISKG

SEQ ID NO: 1095 - protein, 10 aa, Homo sapiens
TARIRAVGLL

SEQ ID NO: 1096 - protein, 10 aa, Homo sapiens
TVISKGCSLN

SEQ ID NO: 1097 - protein, 10 aa, Homo sapiens
QPGTALLCYS

SEQ ID NO: 1098 - protein, 10 aa, Homo sapiens
NCVDDSQDYY

SEQ ID NO: 1099 - protein, 10 aa, Homo sapiens
CKAQVSNEDC

SEQ ID NO: 1100 - protein, 10 aa, Homo sapiens
YYVGKKNITC

SEQ ID NO: 1101 - protein, 10 aa, Homo sapiens
SQDYYVGKKN

SEQ ID NO: 1102 - protein, 10 aa, Homo sapiens
AVGLLTVISK

SEQ ID NO: 1103 - protein, 10 aa, Homo sapiens
IRAVGLLTVI

SEQ ID NO: 1104 - protein, 10 aa, Homo sapiens
DTDLCNASGA

SEQ ID NO: 1105 - protein, 10 aa, Homo sapiens
ITCCDTDLCN

SEQ ID NO: 1106 - protein, 10 aa, Homo sapiens
AQVSNEDCLQ

SEQ ID NO: 1107 - protein, 10 aa, Homo sapiens
ENCTQLGEQC

SEQ ID NO: 1108 - protein, 10 aa, Homo sapiens
LCYSCKAQVS

SEQ ID NO: 1109 - protein, 10 aa, Homo sapiens
ARIRAVGLLT

SEQ ID NO: 1110 - protein, 10 aa, Homo sapiens
YSCKAQVSNE

SEQ ID NO: 1111 - protein, 10 aa, Homo sapiens
LNCVDDSQDY

SEQ ID NO: 1112 - protein, 10 aa, Homo sapiens
EDCLQVENCT

SEQ ID NO: 1113 - protein, 10 aa, Homo sapiens
PGTALLCYSC

SEQ ID NO: 1114 - protein, 10 aa, Homo sapiens
VSNEDCLQVE

SEQ ID NO: 1115 - protein, 10 aa, Homo sapiens
LGLLLWGPGQ

SEQ ID NO: 1116 - protein, 10 aa, Homo sapiens
GCSLNCVDDS

SEQ ID NO: 1117 - protein, 10 aa, Homo sapiens
NCTQLGEQCW

SEQ ID NO: 1118 - protein, 10 aa, Homo sapiens
RAVGLLTVIS

SEQ ID NO: 1119 - protein, 10 aa, Homo sapiens
CDTDLCNASG

SEQ ID NO: 1120 - protein, 10 aa, Homo sapiens
GKKNITCCDT

SEQ ID NO: 1121 - protein, 10 aa, Homo sapiens
KGCSLNCVDD

SEQ ID NO: 1122 - protein, 10 aa, Homo sapiens
GTALLCYSCK

SEQ ID NO: 1123 - protein, 10 aa, Homo sapiens
PALGLLLWGP

SEQ ID NO: 1124 - protein, 10 aa, Homo sapiens
NASGAHALQP

SEQ ID NO: 1125 - protein, 10 aa, Homo sapiens
CCDTDLCNAS

SEQ ID NO: 1126 - protein, 10 aa, Homo sapiens
CSLNCVDDSQ

SEQ ID NO: 1127 - protein, 10 aa, Homo sapiens
VENCTQLGEQ

SEQ ID NO: 1128 - protein, 10 aa, Homo sapiens
SNEDCLQVEN

SEQ ID NO: 1129 - protein, 10 aa, Homo sapiens
DYYVGKKNIT

SEQ ID NO: 1130 - protein, 10 aa, Homo sapiens
CNASGAHALQ

SEQ ID NO: 1131 - protein, 10 aa, Homo sapiens
RLWGAPLQPT

SEQ ID NO: 1132 - protein, 10 aa, Homo sapiens
TLGVVPQASV

SEQ ID NO: 1133 - protein, 10 aa, Homo sapiens
SLTMYVCAPV

SEQ ID NO: 1134 - protein, 10 aa, Homo sapiens
RLPPSLRCSL

SEQ ID NO: 1135 - protein, 10 aa, Homo sapiens
VLVPEAHPNA

SEQ ID NO: 1136 - protein, 10 aa, Homo sapiens
VVPQASVPLL

SEQ ID NO: 1137 - protein, 10 aa, Homo sapiens
HLFPQEAFPA

SEQ ID NO: 1138 - protein, 10 aa, Homo sapiens
VLRHLFPQEA

SEQ ID NO: 1139 - protein, 10 aa, Homo sapiens
ALSRTPTRQI

SEQ ID NO: 1140 - protein, 10 aa, Homo sapiens
GVVPQASVPL

SEQ ID NO: 1141 - protein, 10 aa, Homo sapiens
LTHPAQWEPV

SEQ ID NO: 1142 - protein, 10 aa, Homo sapiens
SQVWSVVSPA

SEQ ID NO: 1143 - protein, 10 aa, Homo sapiens
YDLSQVWSVV

SEQ ID NO: 1144 - protein, 10 aa, Homo sapiens
GPAFSTLNPV

SEQ ID NO: 1145 - protein, 10 aa, Homo sapiens
CCFHGPAFST

SEQ ID NO: 1146 - protein, 10 aa, Homo sapiens
GAPLQPTLGV

SEQ ID NO: 1147 - protein, 10 aa, Homo sapiens
TTWARRTSRA

SEQ ID NO: 1148 - protein, 10 aa, Homo sapiens
CSGDPASYRL

SEQ ID NO: 1149 - protein, 10 aa, Homo sapiens
STLNPVLRHL

SEQ ID NO: 1150 - protein, 10 aa, Homo sapiens
ASYRLWGAPL

SEQ ID NO: 1151 - protein, 10 aa, Homo sapiens
AVTPTCATPA

SEQ ID NO: 1152 - protein, 10 aa, Homo sapiens
SLRCSLHSAC

SEQ ID NO: 1153 - protein, 10 aa, Homo sapiens
MPCSRLPPSL

SEQ ID NO: 1154 - protein, 10 aa, Homo sapiens
VPHPDPPMAL

SEQ ID NO: 1155 - protein, 10 aa, Homo sapiens
APLQPTLGVV

SEQ ID NO: 1156 - protein, 10 aa, Homo sapiens
LLTHPAQWEP

SEQ ID NO: 1157 - protein, 10 aa, Homo sapiens
TMYVCAPVPH

SEQ ID NO: 1158 - protein, 10 aa, Homo sapiens
SPAPSRGQAL

SEQ ID NO: 1159 - protein, 10 aa, Homo sapiens
AQWEPVLVPE

SEQ ID NO: 1160 - protein, 10 aa, Homo sapiens
IYDLSQVWSV

SEQ ID NO: 1161 - protein, 10 aa, Homo sapiens
AHPIYDLSQV

SEQ ID NO: 1162 - protein, 10 aa, Homo sapiens
NASLTMYVCA

SEQ ID NO: 1163 - protein, 10 aa, Homo sapiens
HPNASLTMYV

SEQ ID NO: 1164 - protein, 10 aa, Homo sapiens
VPQASVPLLT

SEQ ID NO: 1165 - protein, 10 aa, Homo sapiens
QPTLGVVPQA

SEQ ID NO: 1166 - protein, 10 aa, Homo sapiens
TLNPVLRHLF

SEQ ID NO: 1167 - protein, 10 aa, Homo sapiens
CATPAGPMPC

SEQ ID NO: 1168 - protein, 10 aa, Homo sapiens
RTSRAVTPTC

SEQ ID NO: 1169 - protein, 10 aa, Homo sapiens
IGSIDTDPPA

SEQ ID NO: 1170 - protein, 10 aa, Homo sapiens
PLCCCFHGPA

SEQ ID NO: 1171 - protein, 10 aa, Homo sapiens
LVPEAHPNAS

SEQ ID NO: 1172 - protein, 10 aa, Homo sapiens
RTPTRQIGSI

SEQ ID NO: 1173 - protein, 10 aa, Homo sapiens
DPASYRLWGA

SEQ ID NO: 1174 - protein, 10 aa, Homo sapiens
AFPAHPIYDL

SEQ ID NO: 1175 - protein, 10 aa, Homo sapiens
ASVPLLTHPA

SEQ ID NO: 1176 - protein, 10 aa, Homo sapiens
APVPHPDPPM

SEQ ID NO: 1177 - protein, 10 aa, Homo sapiens
CFHGPAFSTL

SEQ ID NO: 1178 - protein, 10 aa, Homo sapiens
PIYDLSQVWS

SEQ ID NO: 1179 - protein, 10 aa, Homo sapiens
HPAQWEPVLV

SEQ ID NO: 1180 - protein, 10 aa, Homo sapiens
VPEAHPNASL

SEQ ID NO: 1181 - protein, 10 aa, Homo sapiens
SLHSACCSGD

SEQ ID NO: 1182 - protein, 10 aa, Homo sapiens
WARRTSRAVT

SEQ ID NO: 1183 - protein, 10 aa, Homo sapiens
PPADGPSNPL

SEQ ID NO: 1184 - protein, 10 aa, Homo sapiens
QVWSVVSPAP

SEQ ID NO: 1185 - protein, 10 aa, Homo sapiens
PAFSTLNPVL

SEQ ID NO: 1186 - protein, 10 aa, Homo sapiens
PVPHPDPPMA

SEQ ID NO: 1187 - protein, 10 aa, Homo sapiens
VSPAPSRGQA

SEQ ID NO: 1188 - protein, 10 aa, Homo sapiens
FPQEAFPAHP

SEQ ID NO: 1189 - protein, 10 aa, Homo sapiens
ADGPSNPLCC

SEQ ID NO: 1190 - protein, 10 aa, Homo sapiens
PLLTHPAQWE

SEQ ID NO: 1191 - protein, 10 aa, Homo sapiens
PAGPMPCSRL

SEQ ID NO: 1192 - protein, 10 aa, Homo sapiens
SVVSPAPSRG

SEQ ID NO: 1193 - protein, 10 aa, Homo sapiens
THPAQWEPVL

SEQ ID NO: 1194 - protein, 10 aa, Homo sapiens
PSLRCSLHSA

SEQ ID NO: 1195 - protein, 10 aa, Homo sapiens
YVCAPVPHPD

SEQ ID NO: 1196 - protein, 10 aa, Homo sapiens
LQPTLGVVPQ

SEQ ID NO: 1197 - protein, 10 aa, Homo sapiens
DGPSNPLCCC

SEQ ID NO: 1198 - protein, 10 aa, Homo sapiens
EAHPNASLTM

SEQ ID NO: 1199 - protein, 10 aa, Homo sapiens
FSTLNPVLRH

SEQ ID NO: 1200 - protein, 10 aa, Homo sapiens
LWGAPLQPTL

SEQ ID NO: 1201 - protein, 10 aa, Homo sapiens
SIDTDPPADG

SEQ ID NO: 1202 - protein, 10 aa, Homo sapiens
PPMALSRTPT

SEQ ID NO: 1203 - protein, 10 aa, Homo sapiens
WEPVLVPEAH

SEQ ID NO: 1204 - protein, 10 aa, Homo sapiens
PEAHPNASLT

SEQ ID NO: 1205 - protein, 10 aa, Homo sapiens
VPLLTHPAQW

SEQ ID NO: 1206 - protein, 10 aa, Homo sapiens
SNPLCCCFHG

SEQ ID NO: 1207 - protein, 10 aa, Homo sapiens
PMPCSRLPPS

SEQ ID NO: 1208 - protein, 10 aa, Homo sapiens
CCCFHGPAFS

SEQ ID NO: 1209 - protein, 10 aa, Homo sapiens
MTHRTTTWAR

SEQ ID NO: 1210 - protein, 10 aa, Homo sapiens
TSRAVTPTCA

SEQ ID NO: 1211 - protein, 10 aa, Homo sapiens
CSRLPPSLRC

SEQ ID NO: 1212 - protein, 10 aa, Homo sapiens
RRTSRAVTPT

SEQ ID NO: 1213 - protein, 10 aa, Homo sapiens
ATPAGPMPCS

SEQ ID NO: 1214 - protein, 10 aa, Homo sapiens
DLSQVWSVVS

SEQ ID NO: 1215 - protein, 10 aa, Homo sapiens
WGAPLQPTLG

SEQ ID NO: 1216 - protein, 10 aa, Homo sapiens
TWARRTSRAV

SEQ ID NO: 1217 - protein, 10 aa, Homo sapiens
CSLHSACCSG

SEQ ID NO: 1218 - protein, 10 aa, Homo sapiens
VTPTCATPAG

SEQ ID NO: 1219 - protein, 10 aa, Homo sapiens
FPAHPIYDLS

SEQ ID NO: 1220 - protein, 10 aa, Homo sapiens
RQIGSIDTDP

SEQ ID NO: 1221 - protein, 10 aa, Homo sapiens
PQEAFPAHPI

SEQ ID NO: 1222 - protein, 10 aa, Homo sapiens
SVPLLTHPAQ

SEQ ID NO: 1223 - protein, 10 aa, Homo sapiens
MALSRTPTRQ

SEQ ID NO: 1224 - protein, 10 aa, Homo sapiens
NPVLRHLFPQ

SEQ ID NO: 1225 - protein, 10 aa, Homo sapiens
LRCSLHSACC

SEQ ID NO: 1226 - protein, 10 aa, Homo sapiens
SRAVTPTCAT

SEQ ID NO: 1227 - protein, 10 aa, Homo sapiens
SACCSGDPAS

SEQ ID NO: 1228 - protein, 10 aa, Homo sapiens
QIGSIDTDPP

SEQ ID NO: 1229 - protein, 10 aa, Homo sapiens
LNPVLRHLFP

SEQ ID NO: 1230 - protein, 10 aa, Homo sapiens
FHGPAFSTLN

SEQ ID NO: 1231 - protein, 10 aa, Homo sapiens
RLLPSLRCSL

SEQ ID NO: 1232 - protein, 10 aa, Homo sapiens
MPCSRLLPSL

SEQ ID NO: 1233 - protein, 10 aa, Homo sapiens
LLPSLRCSLH

SEQ ID NO: 1234 - protein, 10 aa, Homo sapiens
AGPMPCSRLL

SEQ ID NO: 1235 - protein, 10 aa, Homo sapiens
PMPCSRLLPS

SEQ ID NO: 1236 - protein, 10 aa, Homo sapiens
CSRLLPSLRC

SEQ ID NO: 1237 - protein, 10 aa, Homo sapiens
LPSLRCSLHS

SEQ ID NO: 1238 - protein, 10 aa, Homo sapiens
GPMPCSRLLP

SEQ ID NO: 1239 - protein, 10 aa, Homo sapiens
SRLLPSLRCS

SEQ ID NO: 1240 - protein, 10 aa, Homo sapiens
PCSRLLPSLR

SEQ ID NO: 1241 - protein, 10 aa, Homo sapiens
CSGDPASSRL

SEQ ID NO: 1242 - protein, 10 aa, Homo sapiens
ASSRLWGAPL

SEQ ID NO: 1243 - protein, 10 aa, Homo sapiens
DPASSRLWGA

SEQ ID NO: 1244 - protein, 10 aa, Homo sapiens
GDPASSRLWG

SEQ ID NO: 1245 - protein, 10 aa, Homo sapiens
ACCSGDPASS

SEQ ID NO: 1246 - protein, 10 aa, Homo sapiens
CCSGDPASSR

SEQ ID NO: 1247 - protein, 10 aa, Homo sapiens
SGDPASSRLW

SEQ ID NO: 1248 - protein, 10 aa, Homo sapiens
SRLWGAPLQP

SEQ ID NO: 1249 - protein, 10 aa, Homo sapiens
SSRLWGAPLQ

SEQ ID NO: 1250 - protein, 10 aa, Homo sapiens
PASSRLWGAP

SEQ ID NO: 1251 - protein, 10 aa, Homo sapiens
LLTDPAQWEP

SEQ ID NO: 1252 - protein, 10 aa, Homo sapiens
LTDPAQWEPV

SEQ ID NO: 1253 - protein, 10 aa, Homo sapiens
DPAQWEPVLV

SEQ ID NO: 1254 - protein, 10 aa, Homo sapiens
ASVPLLTDPA

SEQ ID NO: 1255 - protein, 10 aa, Homo sapiens
TDPAQWEPVL

SEQ ID NO: 1256 - protein, 10 aa, Homo sapiens
PLLTDPAQWE

SEQ ID NO: 1257 - protein, 10 aa, Homo sapiens
VPLLTDPAQW

SEQ ID NO: 1258 - protein, 10 aa, Homo sapiens
SVPLLTDPAQ

SEQ ID NO: 1259 - protein, 10 aa, Homo sapiens
QASVPLLTDP

SEQ ID NO: 1260 - protein, 10 aa, Homo sapiens
PQASVPLLTD

SEQ ID NO: 1261 - protein, 10 aa, Homo sapiens
DLAQWEPVLV

SEQ ID NO: 1262 - protein, 10 aa, Homo sapiens
LLTDLAQWEP

SEQ ID NO: 1263 - protein, 10 aa, Homo sapiens
QASVPLLTDL

SEQ ID NO: 1264 - protein, 10 aa, Homo sapiens
LTDLAQWEPV

SEQ ID NO: 1265 - protein, 10 aa, Homo sapiens
TDLAQWEPVL

SEQ ID NO: 1266 - protein, 10 aa, Homo sapiens
ASVPLLTDLA

SEQ ID NO: 1267 - protein, 10 aa, Homo sapiens
VPLLTDLAQW

SEQ ID NO: 1268 - protein, 10 aa, Homo sapiens
PLLTDLAQWE

SEQ ID NO: 1269 - protein, 10 aa, Homo sapiens
SVPLLTDLAQ

SEQ ID NO: 1270 - protein, 10 aa, Homo sapiens
HLAQWEPVLV

SEQ ID NO: 1271 - protein, 10 aa, Homo sapiens
LTHLAQWEPV

SEQ ID NO: 1272 - protein, 10 aa, Homo sapiens
QASVPLLTHL

SEQ ID NO: 1273 - protein, 10 aa, Homo sapiens
LLTHLAQWEP

SEQ ID NO: 1274 - protein, 10 aa, Homo sapiens
ASVPLLTHLA

SEQ ID NO: 1275 - protein, 10 aa, Homo sapiens
THLAQWEPVL

SEQ ID NO: 1276 - protein, 10 aa, Homo sapiens
VPLLTHLAQW

SEQ ID NO: 1277 - protein, 10 aa, Homo sapiens
PLLTHLAQWE

SEQ ID NO: 1278 - protein, 10 aa, Homo sapiens
SVPLLTHLAQ

SEQ ID NO: 1279 - protein, 10 aa, Homo sapiens
LAQWEPVLVP

SEQ ID NO: 1280 - protein, 10 aa, Homo sapiens
SLTMYVCTPV

SEQ ID NO: 1281 - protein, 10 aa, Homo sapiens
TMYVCTPVPH

SEQ ID NO: 1282 - protein, 10 aa, Homo sapiens
NASLTMYVCT

SEQ ID NO: 1283 - protein, 10 aa, Homo sapiens
TPVPHPDPPM

SEQ ID NO: 1284 - protein, 10 aa, Homo sapiens
YVCTPVPHPD

SEQ ID NO: 1285 - protein, 10 aa, Homo sapiens
ASLTMYVCTP

SEQ ID NO: 1286 - protein, 10 aa, Homo sapiens
LTMYVCTPVP

SEQ ID NO: 1287 - protein, 10 aa, Homo sapiens
VCTPVPHPDP

SEQ ID NO: 1288 - protein, 10 aa, Homo sapiens
CTPVPHPDPP

SEQ ID NO: 1289 - protein, 10 aa, Homo sapiens
MYVCTPVPHP

SEQ ID NO: 1290 - protein, 10 aa, Homo sapiens
RTPTRQISSI

SEQ ID NO: 1291 - protein, 10 aa, Homo sapiens
ISSIDTDPPA

SEQ ID NO: 1292 - protein, 10 aa, Homo sapiens
RQISSIDTDP

SEQ ID NO: 1293 - protein, 10 aa, Homo sapiens
QISSIDTDPP

SEQ ID NO: 1294 - protein, 10 aa, Homo sapiens
SSIDTDPPAD

SEQ ID NO: 1295 - protein, 10 aa, Homo sapiens
PTRQISSIDT

SEQ ID NO: 1296 - protein, 10 aa, Homo sapiens
TPTRQISSID

SEQ ID NO: 1297 - protein, 10 aa, Homo sapiens
LSRTPTRQIS

SEQ ID NO: 1298 - protein, 10 aa, Homo sapiens
SRTPTRQISS

SEQ ID NO: 1299 - protein, 10 aa, Homo sapiens
TRQISSIDTD

SEQ ID NO: 1300 - protein, 10 aa, Homo sapiens
ISSSDTDPPA

SEQ ID NO: 1301 - protein, 10 aa, Homo sapiens
RTPTRQISSS

SEQ ID NO: 1302 - protein, 10 aa, Homo sapiens
RQISSSDTDP

SEQ ID NO: 1303 - protein, 10 aa, Homo sapiens
QISSSDTDPP

SEQ ID NO: 1304 - protein, 10 aa, Homo sapiens
SSSDTDPPAD

SEQ ID NO: 1305 - protein, 10 aa, Homo sapiens
PTRQISSSDT

SEQ ID NO: 1306 - protein, 10 aa, Homo sapiens
TPTRQISSSD

SEQ ID NO: 1307 - protein, 10 aa, Homo sapiens
TRQISSSDTD

SEQ ID NO: 1308 - protein, 10 aa, Homo sapiens
IGSSDTDPPA

SEQ ID NO: 1309 - protein, 10 aa, Homo sapiens
RQIGSSDTDP

SEQ ID NO: 1310 - protein, 10 aa, Homo sapiens
QIGSSDTDPP

SEQ ID NO: 1311 - protein, 10 aa, Homo sapiens
GSSDTDPPAD

SEQ ID NO: 1312 - protein, 10 aa, Homo sapiens
RTPTRQIGSS

SEQ ID NO: 1313 - protein, 10 aa, Homo sapiens
SSDTDPPADG

SEQ ID NO: 1314 - protein, 10 aa, Homo sapiens
PTRQIGSSDT

SEQ ID NO: 1315 - protein, 10 aa, Homo sapiens
TPTRQIGSSD

SEQ ID NO: 1316 - protein, 10 aa, Homo sapiens
SDTDPPADGP

SEQ ID NO: 1317 - protein, 10 aa, Homo sapiens
TRQIGSSDTD

SEQ ID NO: 1318 - protein, 10 aa, Homo sapiens
PSRGQALRRA

SEQ ID NO: 1319 - protein, 10 aa, Homo sapiens
SRGQALRRAQ

SEQ ID NO: 1320 - protein, 9 aa, Homo sapiens
ALLMAGLAL

SEQ ID NO: 1321 - protein, 9 aa, Homo sapiens
SQDYYVGKK

SEQ ID NO: 1322 - protein, 9 aa, Homo sapiens
LLPALGLLL

SEQ ID NO: 1323 - protein, 9 aa, Homo sapiens
LLALLMAGL

SEQ ID NO: 1324 - protein, 9 aa, Homo sapiens
ALQPAAAIL

SEQ ID NO: 1325 - protein, 9 aa, Homo sapiens
ALQPGTALL

SEQ ID NO: 1326 - protein, 9 aa, Homo sapiens
QLGEQCWTA

SEQ ID NO: 1327 - protein, 9 aa, Homo sapiens
ALLCYSCKA

SEQ ID NO: 1328 - protein, 9 aa, Homo sapiens
ALLPALGLL

SEQ ID NO: 1329 - protein, 9 aa, Homo sapiens
CVDDSQDYY

SEQ ID NO: 1330 - protein, 9 aa, Homo sapiens
TALLCYSCK

SEQ ID NO: 1331 - protein, 9 aa, Homo sapiens
LLLWGPGQL

SEQ ID NO: 1332 - protein, 9 aa, Homo sapiens
GLLLWGPGQ

SEQ ID NO: 1333 - protein, 9 aa, Homo sapiens
GLLTVISKG

SEQ ID NO: 1334 - protein, 9 aa, Homo sapiens
VGLLTVISK

SEQ ID NO: 1335 - protein, 9 aa, Homo sapiens
GLALQPGTA

SEQ ID NO: 1336 - protein, 9 aa, Homo sapiens
LLTVISKGC

SEQ ID NO: 1337 - protein, 9 aa, Homo sapiens
AILALLPAL

SEQ ID NO: 1338 - protein, 9 aa, Homo sapiens
QPGTALLCY

SEQ ID NO: 1339 - protein, 9 aa, Homo sapiens
ALGLLLWGP

SEQ ID NO: 1340 - protein, 9 aa, Homo sapiens
VLLALLMAG

SEQ ID NO: 1341 - protein, 9 aa, Homo sapiens
AVLLALLMA

SEQ ID NO: 1342 - protein, 9 aa, Homo sapiens
TVISKGCSL

SEQ ID NO: 1343 - protein, 9 aa, Homo sapiens
GTALLCYSC

SEQ ID NO: 1344 - protein, 9 aa, Homo sapiens
DSQDYYVGK

SEQ ID NO: 1345 - protein, 9 aa, Homo sapiens
NITCCDTDL

SEQ ID NO: 1346 - protein, 9 aa, Homo sapiens
NCVDDSQDY

SEQ ID NO: 1347 - protein, 9 aa, Homo sapiens
LMAGLALQP

SEQ ID NO: 1348 - protein, 9 aa, Homo sapiens
LLMAGLALQ

SEQ ID NO: 1349 - protein, 9 aa, Homo sapiens
LQVENCTQL

SEQ ID NO: 1350 - protein, 9 aa, Homo sapiens
YVGKKNITC

SEQ ID NO: 1351 - protein, 9 aa, Homo sapiens
RIRAVGLLT

SEQ ID NO: 1352 - protein, 9 aa, Homo sapiens
SLNCVDDSQ

SEQ ID NO: 1353 - protein, 9 aa, Homo sapiens
LALLPALGL

SEQ ID NO: 1354 - protein, 9 aa, Homo sapiens
AQVSNEDCL

SEQ ID NO: 1355 - protein, 9 aa, Homo sapiens
RAVGLLTVI

SEQ ID NO: 1356 - protein, 9 aa, Homo sapiens
CLQVENCTQ

SEQ ID NO: 1357 - protein, 9 aa, Homo sapiens
QCWTARIRA

SEQ ID NO: 1358 - protein, 9 aa, Homo sapiens
ILALLPALG

SEQ ID NO: 1359 - protein, 9 aa, Homo sapiens
QPAAAILAL

SEQ ID NO: 1360 - protein, 9 aa, Homo sapiens
LQPGTALLC

SEQ ID NO: 1361 - protein, 9 aa, Homo sapiens
KAVLLALLM

SEQ ID NO: 1362 - protein, 9 aa, Homo sapiens
DLCNASGAH

SEQ ID NO: 1363 - protein, 9 aa, Homo sapiens
GEQCWTARI

SEQ ID NO: 1364 - protein, 9 aa, Homo sapiens
LALQPGTAL

SEQ ID NO: 1365 - protein, 9 aa, Homo sapiens
HALQPAAAI

SEQ ID NO: 1366 - protein, 9 aa, Homo sapiens
LQPAAAILA

SEQ ID NO: 1367 - protein, 9 aa, Homo sapiens
CTQLGEQCW

SEQ ID NO: 1368 - protein, 9 aa, Homo sapiens
ITCCDTDLC

SEQ ID NO: 1369 - protein, 9 aa, Homo sapiens
LLCYSCKAQ

SEQ ID NO: 1370 - protein, 9 aa, Homo sapiens
LCYSCKAQV

SEQ ID NO: 1371 - protein, 9 aa, Homo sapiens
AAILALLPA

SEQ ID NO: 1372 - protein, 9 aa, Homo sapiens
TQLGEQCWT

SEQ ID NO: 1373 - protein, 9 aa, Homo sapiens
LPALGLLLW

SEQ ID NO: 1374 - protein, 9 aa, Homo sapiens
GAHALQPAA

SEQ ID NO: 1375 - protein, 9 aa, Homo sapiens
KAQVSNEDC

SEQ ID NO: 1376 - protein, 9 aa, Homo sapiens
TARIRAVGL

SEQ ID NO: 1377 - protein, 9 aa, Homo sapiens
AVGLLTVIS

SEQ ID NO: 1378 - protein, 9 aa, Homo sapiens
LGEQCWTAR

SEQ ID NO: 1379 - protein, 9 aa, Homo sapiens
EQCWTARIR

SEQ ID NO: 1380 - protein, 9 aa, Homo sapiens
VSNEDCLQV

SEQ ID NO: 1381 - protein, 9 aa, Homo sapiens
ISKGCSLNC

SEQ ID NO: 1382 - protein, 9 aa, Homo sapiens
CCDTDLCNA

SEQ ID NO: 1383 - protein, 9 aa, Homo sapiens
NCTQLGEQC

SEQ ID NO: 1384 - protein, 9 aa, Homo sapiens
QVENCTQLG

SEQ ID NO: 1385 - protein, 9 aa, Homo sapiens
VISKGCSLN

SEQ ID NO: 1386 - protein, 9 aa, Homo sapiens
LCNASGAHA

SEQ ID NO: 1387 - protein, 9 aa, Homo sapiens
QVSNEDCLQ

SEQ ID NO: 1388 - protein, 9 aa, Homo sapiens
WTARIRAVG

SEQ ID NO: 1389 - protein, 9 aa, Homo sapiens
PAAAILALL

SEQ ID NO: 1390 - protein, 9 aa, Homo sapiens
CNASGAHAL

SEQ ID NO: 1391 - protein, 9 aa, Homo sapiens
MKAVLLALL

SEQ ID NO: 1392 - protein, 9 aa, Homo sapiens
LTVISKGCS

SEQ ID NO: 1393 - protein, 9 aa, Homo sapiens
CSLNCVDDS

SEQ ID NO: 1394 - protein, 9 aa, Homo sapiens
LALLMAGLA

SEQ ID NO: 1395 - protein, 9 aa, Homo sapiens
ARIRAVGLL

SEQ ID NO: 1396 - protein, 9 aa, Homo sapiens
DCLQVENCT

SEQ ID NO: 1397 - protein, 9 aa, Homo sapiens
SCKAQVSNE

SEQ ID NO: 1398 - protein, 9 aa, Homo sapiens
VDDSQDYYV

SEQ ID NO: 1399 - protein, 9 aa, Homo sapiens
IRAVGLLTV

SEQ ID NO: 1400 - protein, 9 aa, Homo sapiens
GCSLNCVDD

SEQ ID NO: 1401 - protein, 9 aa, Homo sapiens
DYYVGKKNI

SEQ ID NO: 1402 - protein, 9 aa, Homo sapiens
AAAILALLP

SEQ ID NO: 1403 - protein, 9 aa, Homo sapiens
TCCDTDLCN

SEQ ID NO: 1404 - protein, 9 aa, Homo sapiens
NASGAHALQ

SEQ ID NO: 1405 - protein, 9 aa, Homo sapiens
MAGLALQPG

SEQ ID NO: 1406 - protein, 9 aa, Homo sapiens
VGKKNITCC

SEQ ID NO: 1407 - protein, 9 aa, Homo sapiens
KKNITCCDT

SEQ ID NO: 1408 - protein, 9 aa, Homo sapiens
SKGCSLNCV

SEQ ID NO: 1409 - protein, 9 aa, Homo sapiens
TDLCNASGA

SEQ ID NO: 1410 - protein, 9 aa, Homo sapiens
DTDLCNASG

SEQ ID NO: 1411 - protein, 9 aa, Homo sapiens
SGAHALQPA

SEQ ID NO: 1412 - protein, 9 aa, Homo sapiens
YYVGKKNIT

SEQ ID NO: 1413 - protein, 9 aa, Homo sapiens
AHALQPAAA

SEQ ID NO: 1414 - protein, 9 aa, Homo sapiens
ASGAHALQP

SEQ ID NO: 1415 - protein, 9 aa, Homo sapiens
KNITCCDTD

SEQ ID NO: 1416 - protein, 9 aa, Homo sapiens
EDCLQVENC

SEQ ID NO: 1417 - protein, 9 aa, Homo sapiens
AGLALQPGT

SEQ ID NO: 1418 - protein, 9 aa, Homo sapiens
PALGLLLWG

SEQ ID NO: 1419 - protein, 9 aa, Homo sapiens
VENCTQLGE

SEQ ID NO: 1420 - protein, 9 aa, Homo sapiens
TTWARRTSR

SEQ ID NO: 1421 - protein, 9 aa, Homo sapiens
SVVSPAPSR

SEQ ID NO: 1422 - protein, 9 aa, Homo sapiens
QVWSVVSPA

SEQ ID NO: 1423 - protein, 9 aa, Homo sapiens
RLWGAPLQP

SEQ ID NO: 1424 - protein, 9 aa, Homo sapiens
SLRCSLHSA

SEQ ID NO: 1425 - protein, 9 aa, Homo sapiens
TLNPVLRHL

SEQ ID NO: 1426 - protein, 9 aa, Homo sapiens
SLTMYVCAP

SEQ ID NO: 1427 - protein, 9 aa, Homo sapiens
HLFPQEAFP

SEQ ID NO: 1428 - protein, 9 aa, Homo sapiens
STLNPVLRH

SEQ ID NO: 1429 - protein, 9 aa, Homo sapiens
TMYVCAPVP

SEQ ID NO: 1430 - protein, 9 aa, Homo sapiens
EAFPAHPIY

SEQ ID NO: 1431 - protein, 9 aa, Homo sapiens
DLSQVWSVV

SEQ ID NO: 1432 - protein, 9 aa, Homo sapiens
CCSGDPASY

SEQ ID NO: 1433 - protein, 9 aa, Homo sapiens
VLRHLFPQE

SEQ ID NO: 1434 - protein, 9 aa, Homo sapiens
HPNASLTMY

SEQ ID NO: 1435 - protein, 9 aa, Homo sapiens
VVPQASVPL

SEQ ID NO: 1436 - protein, 9 aa, Homo sapiens
TLGVVPQAS

SEQ ID NO: 1437 - protein, 9 aa, Homo sapiens
MALSRTPTR

SEQ ID NO: 1438 - protein, 9 aa, Homo sapiens
VLVPEAHPN

SEQ ID NO: 1439 - protein, 9 aa, Homo sapiens
AQWEPVLVP

SEQ ID NO: 1440 - protein, 9 aa, Homo sapiens
FPAHPIYDL

SEQ ID NO: 1441 - protein, 9 aa, Homo sapiens
APSRGQALR

SEQ ID NO: 1442 - protein, 9 aa, Homo sapiens
CSRLPPSLR

SEQ ID NO: 1443 - protein, 9 aa, Homo sapiens
LVPEAHPNA

SEQ ID NO: 1444 - protein, 9 aa, Homo sapiens
PLLTHPAQW

SEQ ID NO: 1445 - protein, 9 aa, Homo sapiens
CSGDPASYR

SEQ ID NO: 1446 - protein, 9 aa, Homo sapiens
LLTHPAQWE

SEQ ID NO: 1447 - protein, 9 aa, Homo sapiens
LTMYVCAPV

SEQ ID NO: 1448 - protein, 9 aa, Homo sapiens
FSTLNPVLR

SEQ ID NO: 1449 - protein, 9 aa, Homo sapiens
SLHSACCSG

SEQ ID NO: 1450 - protein, 9 aa, Homo sapiens
SVPLLTHPA

SEQ ID NO: 1451 - protein, 9 aa, Homo sapiens
ATPAGPMPC

SEQ ID NO: 1452 - protein, 9 aa, Homo sapiens
ALSRTPTRQ

SEQ ID NO: 1453 - protein, 9 aa, Homo sapiens
CCCFHGPAF

SEQ ID NO: 1454 - protein, 9 aa, Homo sapiens
VPQASVPLL

SEQ ID NO: 1455 - protein, 9 aa, Homo sapiens
HPAQWEPVL

SEQ ID NO: 1456 - protein, 9 aa, Homo sapiens
RTSRAVTPT

SEQ ID NO: 1457 - protein, 9 aa, Homo sapiens
GVVPQASVP

SEQ ID NO: 1458 - protein, 9 aa, Homo sapiens
GPSNPLCCC

SEQ ID NO: 1459 - protein, 9 aa, Homo sapiens
PLQPTLGVV

SEQ ID NO: 1460 - protein, 9 aa, Homo sapiens
THRTTTWAR

SEQ ID NO: 1461 - protein, 9 aa, Homo sapiens
PTLGVVPQA

SEQ ID NO: 1462 - protein, 9 aa, Homo sapiens
PIYDLSQVW

SEQ ID NO: 1463 - protein, 9 aa, Homo sapiens
VTPTCATPA

SEQ ID NO: 1464 - protein, 9 aa, Homo sapiens
PMALSRTPT

SEQ ID NO: 1465 - protein, 9 aa, Homo sapiens
MTHRTTTWA

SEQ ID NO: 1466 - protein, 9 aa, Homo sapiens
NASLTMYVC

SEQ ID NO: 1467 - protein, 9 aa, Homo sapiens
FPQEAFPAH

SEQ ID NO: 1468 - protein, 9 aa, Homo sapiens
APLQPTLGV

SEQ ID NO: 1469 - protein, 9 aa, Homo sapiens
YVCAPVPHP

SEQ ID NO: 1470 - protein, 9 aa, Homo sapiens
QASVPLLTH

SEQ ID NO: 1471 - protein, 9 aa, Homo sapiens
RLPPSLRCS

SEQ ID NO: 1472 - protein, 9 aa, Homo sapiens
PAGPMPCSR

SEQ ID NO: 1473 - protein, 9 aa, Homo sapiens
PSRGQALRR

SEQ ID NO: 1474 - protein, 9 aa, Homo sapiens
PLCCCFHGP

SEQ ID NO: 1475 - protein, 9 aa, Homo sapiens
LPPSLRCSL

SEQ ID NO: 1476 - protein, 9 aa, Homo sapiens
RHLFPQEAF

SEQ ID NO: 1477 - protein, 9 aa, Homo sapiens
GSIDTDPPA

SEQ ID NO: 1478 - protein, 9 aa, Homo sapiens
HPIYDLSQV

SEQ ID NO: 1479 - protein, 9 aa, Homo sapiens
LTHPAQWEP

SEQ ID NO: 1480 - protein, 9 aa, Homo sapiens
LNPVLRHLF

SEQ ID NO: 1481 - protein, 9 aa, Homo sapiens
RTPTRQIGS

SEQ ID NO: 1482 - protein, 9 aa, Homo sapiens
HRTTTWARR

SEQ ID NO: 1483 - protein, 9 aa, Homo sapiens
PMPCSRLPP

SEQ ID NO: 1484 - protein, 9 aa, Homo sapiens
PVPHPDPPM

SEQ ID NO: 1485 - protein, 9 aa, Homo sapiens
VVSPAPSRG

SEQ ID NO: 1486 - protein, 9 aa, Homo sapiens
QIGSIDTDP

SEQ ID NO: 1487 - protein, 9 aa, Homo sapiens
AVTPTCATP

SEQ ID NO: 1488 - protein, 9 aa, Homo sapiens
VPHPDPPMA

SEQ ID NO: 1489 - protein, 9 aa, Homo sapiens
SGDPASYRL

SEQ ID NO: 1490 - protein, 9 aa, Homo sapiens
FHGPAFSTL

SEQ ID NO: 1491 - protein, 9 aa, Homo sapiens
YDLSQVWSV

SEQ ID NO: 1492 - protein, 9 aa, Homo sapiens
SQVWSVVSP

SEQ ID NO: 1493 - protein, 9 aa, Homo sapiens
TPTRQIGSI

SEQ ID NO: 1494 - protein, 9 aa, Homo sapiens
QEAFPAHPI

SEQ ID NO: 1495 - protein, 9 aa, Homo sapiens
RAVTPTCAT

SEQ ID NO: 1496 - protein, 9 aa, Homo sapiens
RQIGSIDTD

SEQ ID NO: 1497 - protein, 9 aa, Homo sapiens
RCSLHSACC

SEQ ID NO: 1498 - protein, 9 aa, Homo sapiens
SIDTDPPAD

SEQ ID NO: 1499 - protein, 9 aa, Homo sapiens
SACCSGDPA

SEQ ID NO: 1500 - protein, 9 aa, Homo sapiens
CCFHGPAFS

SEQ ID NO: 1501 - protein, 9 aa, Homo sapiens
SYRLWGAPL

SEQ ID NO: 1502 - protein, 9 aa, Homo sapiens
LCCCFHGPA

SEQ ID NO: 1503 - protein, 9 aa, Homo sapiens
WEPVLVPEA

SEQ ID NO: 1504 - protein, 9 aa, Homo sapiens
PSNPLCCCF

SEQ ID NO: 1505 - protein, 9 aa, Homo sapiens
RTTTWARRT

SEQ ID NO: 1506 - protein, 9 aa, Homo sapiens
PAFSTLNPV

SEQ ID NO: 1507 - protein, 9 aa, Homo sapiens
ASLTMYVCA

SEQ ID NO: 1508 - protein, 9 aa, Homo sapiens
TSRAVTPTC

SEQ ID NO: 1509 - protein, 9 aa, Homo sapiens
TPAGPMPCS

SEQ ID NO: 1510 - protein, 9 aa, Homo sapiens
HPDPPMALS

SEQ ID NO: 1511 - protein, 9 aa, Homo sapiens
SRLPPSLRC

SEQ ID NO: 1512 - protein, 9 aa, Homo sapiens
PVLRHLFPQ

SEQ ID NO: 1513 - protein, 9 aa, Homo sapiens
PADGPSNPL

SEQ ID NO: 1514 - protein, 9 aa, Homo sapiens
EPVLVPEAH

SEQ ID NO: 1515 - protein, 9 aa, Homo sapiens
GPAFSTLNP

SEQ ID NO: 1516 - protein, 9 aa, Homo sapiens
PDPPMALSR

SEQ ID NO: 1517 - protein, 9 aa, Homo sapiens
PASYRLWGA

SEQ ID NO: 1518 - protein, 9 aa, Homo sapiens
WGAPLQPTL

SEQ ID NO: 1519 - protein, 9 aa, Homo sapiens
AGPMPCSRL

SEQ ID NO: 1520 - protein, 9 aa, Homo sapiens
LLPSLRCSL

SEQ ID NO: 1521 - protein, 9 aa, Homo sapiens
CSRLLPSLR

SEQ ID NO: 1522 - protein, 9 aa, Homo sapiens
RLLPSLRCS

SEQ ID NO: 1523 - protein, 9 aa, Homo sapiens
GPMPCSRLL

SEQ ID NO: 1524 - protein, 9 aa, Homo sapiens
PMPCSRLLP

SEQ ID NO: 1525 - protein, 9 aa, Homo sapiens
LPSLRCSLH

SEQ ID NO: 1526 - protein, 9 aa, Homo sapiens
MPCSRLLPS

SEQ ID NO: 1527 - protein, 9 aa, Homo sapiens
PCSRLLPSL

SEQ ID NO: 1528 - protein, 9 aa, Homo sapiens
SRLLPSLRC

SEQ ID NO: 1529 - protein, 9 aa, Homo sapiens
CSGDPASSR

SEQ ID NO: 1530 - protein, 9 aa, Homo sapiens
SSRLWGAPL

SEQ ID NO: 1531 - protein, 9 aa, Homo sapiens
SGDPASSRL

SEQ ID NO: 1532 - protein, 9 aa, Homo sapiens
PASSRLWGA

SEQ ID NO: 1533 - protein, 9 aa, Homo sapiens
CCSGDPASS

SEQ ID NO: 1534 - protein, 9 aa, Homo sapiens
DPASSRLWG

SEQ ID NO: 1535 - protein, 9 aa, Homo sapiens
GDPASSRLW

SEQ ID NO: 1536 - protein, 9 aa, Homo sapiens
SRLWGAPLQ

SEQ ID NO: 1537 - protein, 9 aa, Homo sapiens
ASSRLWGAP

SEQ ID NO: 1538 - protein, 8 aa, Homo sapiens
LLTDPAQW

SEQ ID NO: 1539 - protein, 9 aa, Homo sapiens
LLTDPAQWE

SEQ ID NO: 1540 - protein, 9 aa, Homo sapiens
SVPLLTDPA

SEQ ID NO: 1541 - protein, 9 aa, Homo sapiens
DPAQWEPVL

SEQ ID NO: 1542 - protein, 9 aa, Homo sapiens
LTDPAQWEP

SEQ ID NO: 1543 - protein, 9 aa, Homo sapiens
QASVPLLTD

SEQ ID NO: 1544 - protein, 9 aa, Homo sapiens
ASVPLLTDP

SEQ ID NO: 1545 - protein, 9 aa, Homo sapiens
VPLLTDPAQ

SEQ ID NO: 1546 - protein, 9 aa, Homo sapiens
TDPAQWEPV

SEQ ID NO: 1547 - protein, 9 aa, Homo sapiens
DLAQWEPVL

SEQ ID NO: 1548 - protein, 9 aa, Homo sapiens
PLLTDLAQW

SEQ ID NO: 1549 - protein, 9 aa, Homo sapiens
LLTDLAQWE

SEQ ID NO: 1550 - protein, 9 aa, Homo sapiens
SVPLLTDLA

SEQ ID NO: 1551 - protein, 9 aa, Homo sapiens
ASVPLLTDL

SEQ ID NO: 1552 - protein, 9 aa, Homo sapiens
LTDLAQWEP

SEQ ID NO: 1553 - protein, 9 aa, Homo sapiens
VPLLTDLAQ

SEQ ID NO: 1554 - protein, 9 aa, Homo sapiens
TDLAQWEPV

SEQ ID NO: 1555 - protein, 9 aa, Homo sapiens
HLAQWEPVL

SEQ ID NO: 1556 - protein, 9 aa, Homo sapiens
PLLTHLAQW

SEQ ID NO: 1557 - protein, 9 aa, Homo sapiens
LLTHLAQWE

SEQ ID NO: 1558 - protein, 9 aa, Homo sapiens
SVPLLTHLA

SEQ ID NO: 1559 - protein, 9 aa, Homo sapiens
ASVPLLTHL

SEQ ID NO: 1560 - protein, 9 aa, Homo sapiens
LTHLAQWEP

SEQ ID NO: 1561 - protein, 9 aa, Homo sapiens
LAQWEPVLV

SEQ ID NO: 1562 - protein, 9 aa, Homo sapiens
VPLLTHLAQ

SEQ ID NO: 1563 - protein, 9 aa, Homo sapiens
THLAQWEPV

SEQ ID NO: 1564 - protein, 8 aa, Homo sapiens
LTMYVCTP

SEQ ID NO: 1565 - protein, 9 aa, Homo sapiens
TMYVCTPVP

SEQ ID NO: 1566 - protein, 9 aa, Homo sapiens
LTMYVCTPV

SEQ ID NO: 1567 - protein, 9 aa, Homo sapiens
YVCTPVPHP

SEQ ID NO: 1568 - protein, 9 aa, Homo sapiens
CTPVPHPDP

SEQ ID NO: 1569 - protein, 9 aa, Homo sapiens
ASLTMYVCT

SEQ ID NO: 1570 - protein, 9 aa, Homo sapiens
VCTPVPHPD

SEQ ID NO: 1571 - protein, 9 aa, Homo sapiens
MYVCTPVPH

SEQ ID NO: 1572 - protein, 9 aa, Homo sapiens
TPTRQISSI

SEQ ID NO: 1573 - protein, 9 aa, Homo sapiens
RTPTRQISS

SEQ ID NO: 1574 - protein, 9 aa, Homo sapiens
QISSIDTDP

SEQ ID NO: 1575 - protein, 9 aa, Homo sapiens
SSIDTDPPA

SEQ ID NO: 1576 - protein, 9 aa, Homo sapiens
RQISSIDTD

SEQ ID NO: 1577 - protein, 9 aa, Homo sapiens
TRQISSIDT

SEQ ID NO: 1578 - protein, 9 aa, Homo sapiens
PTRQISSID

SEQ ID NO: 1579 - protein, 9 aa, Homo sapiens
ISSIDTDPP

SEQ ID NO: 1580 - protein, 9 aa, Homo sapiens
SRTPTRQIS

SEQ ID NO: 1581 - protein, 9 aa, Homo sapiens
QISSSDTDP

SEQ ID NO: 1582 - protein, 9 aa, Homo sapiens
SSSDTDPPA

SEQ ID NO: 1583 - protein, 9 aa, Homo sapiens
RQISSSDTD

SEQ ID NO: 1584 - protein, 9 aa, Homo sapiens
TPTRQISSS

SEQ ID NO: 1585 - protein, 9 aa, Homo sapiens
PTRQISSSD

SEQ ID NO: 1586 - protein, 9 aa, Homo sapiens
ISSSDTDPP

SEQ ID NO: 1587 - protein, 9 aa, Homo sapiens
TRQISSSDT

SEQ ID NO: 1588 - protein, 9 aa, Homo sapiens
GSSDTDPPA

SEQ ID NO: 1589 - protein, 9 aa, Homo sapiens
QIGSSDTDP

SEQ ID NO: 1590 - protein, 9 aa, Homo sapiens
RQIGSSDTD

SEQ ID NO: 1591 - protein, 9 aa, Homo sapiens
TPTRQIGSS

SEQ ID NO: 1592 - protein, 9 aa, Homo sapiens
PTRQIGSSD

SEQ ID NO: 1593 - protein, 9 aa, Homo sapiens
SSDTDPPAD

SEQ ID NO: 1594 - protein, 9 aa, Homo sapiens
TRQIGSSDT

SEQ ID NO: 1595 - protein, 9 aa, Homo sapiens
SDTDPPADG

SEQ ID NO: 1596 - protein, 9 aa, Homo sapiens
IGSSDTDPP

SEQ ID NO: 1597 - protein, 9 aa, Homo sapiens
SRGQALRRA

SEQ ID NO: 1598 - protein, 9 aa, Homo sapiens
RGQALRRAQ

SEQ ID NO: 1599 - protein, 10 aa, Homo sapiens
AVGLLTVISK

SEQ ID NO: 1600 - protein, 10 aa, Homo sapiens
QLGEQCWTAR

SEQ ID NO: 1601 - protein, 10 aa, Homo sapiens
GTALLCYSCK

SEQ ID NO: 1602 - protein, 10 aa, Homo sapiens
ALLPALGLLL

SEQ ID NO: 1603 - protein, 10 aa, Homo sapiens
GLALQPGTAL

SEQ ID NO: 1604 - protein, 10 aa, Homo sapiens
ILALLPALGL

SEQ ID NO: 1605 - protein, 10 aa, Homo sapiens
VLLALLMAGL

SEQ ID NO: 1606 - protein, 10 aa, Homo sapiens
GLLLWGPGQL

SEQ ID NO: 1607 - protein, 10 aa, Homo sapiens
GLLTVISKGC

SEQ ID NO: 1608 - protein, 10 aa, Homo sapiens
ALQPGTALLC

SEQ ID NO: 1609 - protein, 10 aa, Homo sapiens
LLPALGLLLW

SEQ ID NO: 1610 - protein, 10 aa, Homo sapiens
CLQVENCTQL

SEQ ID NO: 1611 - protein, 10 aa, Homo sapiens
ALQPAAAILA

SEQ ID NO: 1612 - protein, 10 aa, Homo sapiens
LQPGTALLCY

SEQ ID NO: 1613 - protein, 10 aa, Homo sapiens
LLCYSCKAQV

SEQ ID NO: 1614 - protein, 10 aa, Homo sapiens
DSQDYYVGKK

SEQ ID NO: 1615 - protein, 10 aa, Homo sapiens
DLCNASGAHA

SEQ ID NO: 1616 - protein, 10 aa, Homo sapiens
NCVDDSQDYY

SEQ ID NO: 1617 - protein, 10 aa, Homo sapiens
LLMAGLALQP

SEQ ID NO: 1618 - protein, 10 aa, Homo sapiens
RIRAVGLLTV

SEQ ID NO: 1619 - protein, 10 aa, Homo sapiens
LLALLMAGLA

SEQ ID NO: 1620 - protein, 10 aa, Homo sapiens
CVDDSQDYYV

SEQ ID NO: 1621 - protein, 10 aa, Homo sapiens
LQPAAAILAL

SEQ ID NO: 1622 - protein, 10 aa, Homo sapiens
LTVISKGCSL

SEQ ID NO: 1623 - protein, 10 aa, Homo sapiens
ALLMAGLALQ

SEQ ID NO: 1624 - protein, 10 aa, Homo sapiens
LMAGLALQPG

SEQ ID NO: 1625 - protein, 10 aa, Homo sapiens
TQLGEQCWTA

SEQ ID NO: 1626 - protein, 10 aa, Homo sapiens
VISKGCSLNC

SEQ ID NO: 1627 - protein, 10 aa, Homo sapiens
QVSNEDCLQV

SEQ ID NO: 1628 - protein, 10 aa, Homo sapiens
WTARIRAVGL

SEQ ID NO: 1629 - protein, 10 aa, Homo sapiens
YVGKKNITCC

SEQ ID NO: 1630 - protein, 10 aa, Homo sapiens
KAVLLALLMA

SEQ ID NO: 1631 - protein, 10 aa, Homo sapiens
NITCCDTDLC

SEQ ID NO: 1632 - protein, 10 aa, Homo sapiens
SLNCVDDSQD

SEQ ID NO: 1633 - protein, 10 aa, Homo sapiens
DDSQDYYVGK

SEQ ID NO: 1634 - protein, 10 aa, Homo sapiens
LALLMAGLAL

SEQ ID NO: 1635 - protein, 10 aa, Homo sapiens
KAQVSNEDCL

SEQ ID NO: 1636 - protein, 10 aa, Homo sapiens
ALLCYSCKAQ

SEQ ID NO: 1637 - protein, 10 aa, Homo sapiens
AAILALLPAL

SEQ ID NO: 1638 - protein, 10 aa, Homo sapiens
QPAAAILALL

SEQ ID NO: 1639 - protein, 10 aa, Homo sapiens
LLTVISKGCS

SEQ ID NO: 1640 - protein, 10 aa, Homo sapiens
LALQPGTALL

SEQ ID NO: 1641 - protein, 10 aa, Homo sapiens
TALLCYSCKA

SEQ ID NO: 1642 - protein, 10 aa, Homo sapiens
HALQPAAAIL

SEQ ID NO: 1643 - protein, 10 aa, Homo sapiens
AVLLALLMAG

SEQ ID NO: 1644 - protein, 10 aa, Homo sapiens
LNCVDDSQDY

SEQ ID NO: 1645 - protein, 10 aa, Homo sapiens
ALGLLLWGPG

SEQ ID NO: 1646 - protein, 10 aa, Homo sapiens
GAHALQPAAA

SEQ ID NO: 1647 - protein, 10 aa, Homo sapiens
AAAILALLPA

SEQ ID NO: 1648 - protein, 10 aa, Homo sapiens
LCNASGAHAL

SEQ ID NO: 1649 - protein, 10 aa, Homo sapiens
KNITCCDTDL

SEQ ID NO: 1650 - protein, 10 aa, Homo sapiens
TARIRAVGLL

SEQ ID NO: 1651 - protein, 10 aa, Homo sapiens
CTQLGEQCWT

SEQ ID NO: 1652 - protein, 10 aa, Homo sapiens
LALLPALGLL

SEQ ID NO: 1653 - protein, 10 aa, Homo sapiens
QVENCTQLGE

SEQ ID NO: 1654 - protein, 10 aa, Homo sapiens
GCSLNCVDDS

SEQ ID NO: 1655 - protein, 10 aa, Homo sapiens
GEQCWTARIR

SEQ ID NO: 1656 - protein, 10 aa, Homo sapiens
EQCWTARIRA

SEQ ID NO: 1657 - protein, 10 aa, Homo sapiens
DTDLCNASGA

SEQ ID NO: 1658 - protein, 10 aa, Homo sapiens
AILALLPALG

SEQ ID NO: 1659 - protein, 10 aa, Homo sapiens
TVISKGCSLN

SEQ ID NO: 1660 - protein, 10 aa, Homo sapiens
TCCDTDLCNA

SEQ ID NO: 1661 - protein, 10 aa, Homo sapiens
ISKGCSLNCV

SEQ ID NO: 1662 - protein, 10 aa, Homo sapiens
ITCCDTDLCN

SEQ ID NO: 1663 - protein, 10 aa, Homo sapiens
LCYSCKAQVS

SEQ ID NO: 1664 - protein, 10 aa, Homo sapiens
NCTQLGEQCW

SEQ ID NO: 1665 - protein, 10 aa, Homo sapiens
LGEQCWTARI

SEQ ID NO: 1666 - protein, 10 aa, Homo sapiens
NEDCLQVENC

SEQ ID NO: 1667 - protein, 10 aa, Homo sapiens
QDYYVGKKNI

SEQ ID NO: 1668 - protein, 10 aa, Homo sapiens
QCWTARIRAV

SEQ ID NO: 1669 - protein, 10 aa, Homo sapiens
ASGAHALQPA

SEQ ID NO: 1670 - protein, 10 aa, Homo sapiens
LQVENCTQLG

SEQ ID NO: 1671 - protein, 10 aa, Homo sapiens
MAGLALQPGT

SEQ ID NO: 1672 - protein, 10 aa, Homo sapiens
AHALQPAAAI

SEQ ID NO: 1673 - protein, 10 aa, Homo sapiens
IRAVGLLTVI

SEQ ID NO: 1674 - protein, 10 aa, Homo sapiens
YYVGKKNITC

SEQ ID NO: 1675 - protein, 10 aa, Homo sapiens
AQVSNEDCLQ

SEQ ID NO: 1676 - protein, 10 aa, Homo sapiens
RAVGLLTVIS

SEQ ID NO: 1677 - protein, 10 aa, Homo sapiens
NASGAHALQP

SEQ ID NO: 1678 - protein, 10 aa, Homo sapiens
LPALGLLLWG

SEQ ID NO: 1679 - protein, 10 aa, Homo sapiens
QPGTALLCYS

SEQ ID NO: 1680 - protein, 10 aa, Homo sapiens
ARIRAVGLLT

SEQ ID NO: 1681 - protein, 10 aa, Homo sapiens
SQDYYVGKKN

SEQ ID NO: 1682 - protein, 10 aa, Homo sapiens
MKAVLLALLM

SEQ ID NO: 1683 - protein, 10 aa, Homo sapiens
CCDTDLCNAS

SEQ ID NO: 1684 - protein, 10 aa, Homo sapiens
GKKNITCCDT

SEQ ID NO: 1685 - protein, 10 aa, Homo sapiens
SCKAQVSNED

SEQ ID NO: 1686 - protein, 10 aa, Homo sapiens
YSCKAQVSNE

SEQ ID NO: 1687 - protein, 10 aa, Homo sapiens
VSNEDCLQVE

SEQ ID NO: 1688 - protein, 10 aa, Homo sapiens
CSLNCVDDSQ

SEQ ID NO: 1689 - protein, 10 aa, Homo sapiens
PALGLLLWGP

SEQ ID NO: 1690 - protein, 10 aa, Homo sapiens
CKAQVSNEDC

SEQ ID NO: 1691 - protein, 10 aa, Homo sapiens
SGAHALQPAA

SEQ ID NO: 1692 - protein, 10 aa, Homo sapiens
DYYVGKKNIT

SEQ ID NO: 1693 - protein, 10 aa, Homo sapiens
ENCTQLGEQC

SEQ ID NO: 1694 - protein, 10 aa, Homo sapiens
LGLLLWGPGQ

SEQ ID NO: 1695 - protein, 10 aa, Homo sapiens
TDLCNASGAH

SEQ ID NO: 1696 - protein, 10 aa, Homo sapiens
AGLALQPGTA

SEQ ID NO: 1697 - protein, 10 aa, Homo sapiens
DCLQVENCTQ

SEQ ID NO: 1698 - protein, 10 aa, Homo sapiens
VGLLTVISKG

SEQ ID NO: 1699 - protein, 10 aa, Homo sapiens
HLFPQEAFPA

SEQ ID NO: 1700 - protein, 10 aa, Homo sapiens
TLNPVLRHLF

SEQ ID NO: 1701 - protein, 10 aa, Homo sapiens
RLWGAPLQPT

SEQ ID NO: 1702 - protein, 10 aa, Homo sapiens
TMYVCAPVPH

SEQ ID NO: 1703 - protein, 10 aa, Homo sapiens
RLPPSLRCSL

SEQ ID NO: 1704 - protein, 10 aa, Homo sapiens
MTHRTTTWAR

SEQ ID NO: 1705 - protein, 10 aa, Homo sapiens
VLRHLFPQEA

SEQ ID NO: 1706 - protein, 10 aa, Homo sapiens
VLVPEAHPNA

SEQ ID NO: 1707 - protein, 10 aa, Homo sapiens
GVVPQASVPL

SEQ ID NO: 1708 - protein, 10 aa, Homo sapiens
PMALSRTPTR

SEQ ID NO: 1709 - protein, 10 aa, Homo sapiens
SLTMYVCAPV

SEQ ID NO: 1710 - protein, 10 aa, Homo sapiens
TLGVVPQASV

SEQ ID NO: 1711 - protein, 10 aa, Homo sapiens
TTTWARRTSR

SEQ ID NO: 1712 - protein, 10 aa, Homo sapiens
SLRCSLHSAC

SEQ ID NO: 1713 - protein, 10 aa, Homo sapiens
VVPQASVPLL

SEQ ID NO: 1714 - protein, 10 aa, Homo sapiens
HPDPPMALSR

SEQ ID NO: 1715 - protein, 10 aa, Homo sapiens
CCSGDPASYR

SEQ ID NO: 1716 - protein, 10 aa, Homo sapiens
ALSRTPTRQI

SEQ ID NO: 1717 - protein, 10 aa, Homo sapiens
APSRGQALRR

SEQ ID NO: 1718 - protein, 10 aa, Homo sapiens
LLTHPAQWEP

SEQ ID NO: 1719 - protein, 10 aa, Homo sapiens
TPAGPMPCSR

SEQ ID NO: 1720 - protein, 10 aa, Homo sapiens
GPSNPLCCCF

SEQ ID NO: 1721 - protein, 10 aa, Homo sapiens
TTWARRTSRA

SEQ ID NO: 1722 - protein, 10 aa, Homo sapiens
WSVVSPAPSR

SEQ ID NO: 1723 - protein, 10 aa, Homo sapiens
ASYRLWGAPL

SEQ ID NO: 1724 - protein, 10 aa, Homo sapiens
SQVWSVVSPA

SEQ ID NO: 1725 - protein, 10 aa, Homo sapiens
ACCSGDPASY

SEQ ID NO: 1726 - protein, 10 aa, Homo sapiens
DLSQVWSVVS

SEQ ID NO: 1727 - protein, 10 aa, Homo sapiens
AVTPTCATPA

SEQ ID NO: 1728 - protein, 10 aa, Homo sapiens
VPHPDPPMAL

SEQ ID NO: 1729 - protein, 10 aa, Homo sapiens
CCFHGPAFST

SEQ ID NO: 1730 - protein, 10 aa, Homo sapiens
LCCCFHGPAF

SEQ ID NO: 1731 - protein, 10 aa, Homo sapiens
SLHSACCSGD

SEQ ID NO: 1732 - protein, 10 aa, Homo sapiens
GAPLQPTLGV

SEQ ID NO: 1733 - protein, 10 aa, Homo sapiens
PLCCCFHGPA

SEQ ID NO: 1734 - protein, 10 aa, Homo sapiens
RTSRAVTPTC

SEQ ID NO: 1735 - protein, 10 aa, Homo sapiens
QVWSVVSPAP

SEQ ID NO: 1736 - protein, 10 aa, Homo sapiens
LTHPAQWEPV

SEQ ID NO: 1737 - protein, 10 aa, Homo sapiens
RTPTRQIGSI

SEQ ID NO: 1738 - protein, 10 aa, Homo sapiens
QEAFPAHPIY

SEQ ID NO: 1739 - protein, 10 aa, Homo sapiens
AQWEPVLVPE

SEQ ID NO: 1740 - protein, 10 aa, Homo sapiens
STLNPVLRHL

SEQ ID NO: 1741 - protein, 10 aa, Homo sapiens
FSTLNPVLRH

SEQ ID NO: 1742 - protein, 10 aa, Homo sapiens
SPAPSRGQAL

SEQ ID NO: 1743 - protein, 10 aa, Homo sapiens
VPEAHPNASL

SEQ ID NO: 1744 - protein, 10 aa, Homo sapiens
QPTLGVVPQA

SEQ ID NO: 1745 - protein, 10 aa, Homo sapiens
GPAFSTLNPV

SEQ ID NO: 1746 - protein, 10 aa, Homo sapiens
CSGDPASYRL

SEQ ID NO: 1747 - protein, 10 aa, Homo sapiens
APVPHPDPPM

SEQ ID NO: 1748 - protein, 10 aa, Homo sapiens
AHPNASLTMY

SEQ ID NO: 1749 - protein, 10 aa, Homo sapiens
PCSRLPPSLR

SEQ ID NO: 1750 - protein, 10 aa, Homo sapiens
CATPAGPMPC

SEQ ID NO: 1751 - protein, 10 aa, Homo sapiens
MPCSRLPPSL

SEQ ID NO: 1752 - protein, 10 aa, Homo sapiens
LVPEAHPNAS

SEQ ID NO: 1753 - protein, 10 aa, Homo sapiens
PMPCSRLPPS

SEQ ID NO: 1754 - protein, 10 aa, Homo sapiens
PLLTHPAQWE

SEQ ID NO: 1755 - protein, 10 aa, Homo sapiens
ATPAGPMPCS

SEQ ID NO: 1756 - protein, 10 aa, Homo sapiens
AFPAHPIYDL

SEQ ID NO: 1757 - protein, 10 aa, Homo sapiens
THRTTTWARR

SEQ ID NO: 1758 - protein, 10 aa, Homo sapiens
AFSTLNPVLR

SEQ ID NO: 1759 - protein, 10 aa, Homo sapiens
HPNASLTMYV

SEQ ID NO: 1760 - protein, 10 aa, Homo sapiens
PAPSRGQALR

SEQ ID NO: 1761 - protein, 10 aa, Homo sapiens
LRHLFPQEAF

SEQ ID NO: 1762 - protein, 10 aa, Homo sapiens
PAFSTLNPVL

SEQ ID NO: 1763 - protein, 10 aa, Homo sapiens
VPQASVPLLT

SEQ ID NO: 1764 - protein, 10 aa, Homo sapiens
SVVSPAPSRG

SEQ ID NO: 1765 - protein, 10 aa, Homo sapiens
HPIYDLSQVW

SEQ ID NO: 1766 - protein, 10 aa, Homo sapiens
VPLLTHPAQW

SEQ ID NO: 1767 - protein, 10 aa, Homo sapiens
CSRLPPSLRC

SEQ ID NO: 1768 - protein, 10 aa, Homo sapiens
YVCAPVPHPD

SEQ ID NO: 1769 - protein, 10 aa, Homo sapiens
SIDTDPPADG

SEQ ID NO: 1770 - protein, 10 aa, Homo sapiens
PLQPTLGVVP

SEQ ID NO: 1771 - protein, 10 aa, Homo sapiens
PQEAFPAHPI

SEQ ID NO: 1772 - protein, 10 aa, Homo sapiens
GPMPCSRLPP

SEQ ID NO: 1773 - protein, 10 aa, Homo sapiens
CFHGPAFSTL

SEQ ID NO: 1774 - protein, 10 aa, Homo sapiens
PQASVPLLTH

SEQ ID NO: 1775 - protein, 10 aa, Homo sapiens
DPASYRLWGA

SEQ ID NO: 1776 - protein, 10 aa, Homo sapiens
ASVPLLTHPA

SEQ ID NO: 1777 - protein, 10 aa, Homo sapiens
RQIGSIDTDP

SEQ ID NO: 1778 - protein, 10 aa, Homo sapiens
NASLTMYVCA

SEQ ID NO: 1779 - protein, 10 aa, Homo sapiens
PVPHPDPPMA

SEQ ID NO: 1780 - protein, 10 aa, Homo sapiens
LPPSLRCSLH

SEQ ID NO: 1781 - protein, 10 aa, Homo sapiens
SVPLLTHPAQ

SEQ ID NO: 1782 - protein, 10 aa, Homo sapiens
HPAQWEPVLV

SEQ ID NO: 1783 - protein, 10 aa, Homo sapiens
QIGSIDTDPP

SEQ ID NO: 1784 - protein, 10 aa, Homo sapiens
PIYDLSQVWS

SEQ ID NO: 1785 - protein, 10 aa, Homo sapiens
IYDLSQVWSV

SEQ ID NO: 1786 - protein, 10 aa, Homo sapiens
THPAQWEPVL

SEQ ID NO: 1787 - protein, 10 aa, Homo sapiens
LQPTLGVVPQ

SEQ ID NO: 1788 - protein, 10 aa, Homo sapiens
EAHPNASLTM

SEQ ID NO: 1789 - protein, 10 aa, Homo sapiens
LTMYVCAPVP

SEQ ID NO: 1790 - protein, 10 aa, Homo sapiens
ASLTMYVCAP

SEQ ID NO: 1791 - protein, 10 aa, Homo sapiens
NPVLRHLFPQ

SEQ ID NO: 1792 - protein, 10 aa, Homo sapiens
PAGPMPCSRL

SEQ ID NO: 1793 - protein, 10 aa, Homo sapiens
APLQPTLGVV

SEQ ID NO: 1794 - protein, 10 aa, Homo sapiens
VTPTCATPAG

SEQ ID NO: 1795 - protein, 10 aa, Homo sapiens
HSACCSGDPA

SEQ ID NO: 1796 - protein, 10 aa, Homo sapiens
PTRQIGSIDT

SEQ ID NO: 1797 - protein, 10 aa, Homo sapiens
TSRAVTPTCA

SEQ ID NO: 1798 - protein, 10 aa, Homo sapiens
WARRTSRAVT

SEQ ID NO: 1799 - protein, 10 aa, Homo sapiens
RLLPSLRCSL

SEQ ID NO: 1800 - protein, 10 aa, Homo sapiens
LLPSLRCSLH

SEQ ID NO: 1801 - protein, 10 aa, Homo sapiens
PMPCSRLLPS

SEQ ID NO: 1802 - protein, 10 aa, Homo sapiens
MPCSRLLPSL

SEQ ID NO: 1803 - protein, 10 aa, Homo sapiens
PCSRLLPSLR

SEQ ID NO: 1804 - protein, 10 aa, Homo sapiens
CSRLLPSLRC

SEQ ID NO: 1805 - protein, 10 aa, Homo sapiens
GPMPCSRLLP

SEQ ID NO: 1806 - protein, 10 aa, Homo sapiens
LPSLRCSLHS

SEQ ID NO: 1807 - protein, 10 aa, Homo sapiens
AGPMPCSRLL

SEQ ID NO: 1808 - protein, 10 aa, Homo sapiens
SRLLPSLRCS

SEQ ID NO: 1809 - protein, 10 aa, Homo sapiens
CCSGDPASSR

SEQ ID NO: 1810 - protein, 10 aa, Homo sapiens
ASSRLWGAPL

SEQ ID NO: 1811 - protein, 10 aa, Homo sapiens
CSGDPASSRL

SEQ ID NO: 1812 - protein, 10 aa, Homo sapiens
DPASSRLWGA

SEQ ID NO: 1813 - protein, 10 aa, Homo sapiens
ACCSGDPASS

SEQ ID NO: 1814 - protein, 10 aa, Homo sapiens
GDPASSRLWG

SEQ ID NO: 1815 - protein, 10 aa, Homo sapiens
SSRLWGAPLQ

SEQ ID NO: 1816 - protein, 10 aa, Homo sapiens
SRLWGAPLQP

SEQ ID NO: 1817 - protein, 10 aa, Homo sapiens
SGDPASSRLW

SEQ ID NO: 1818 - protein, 10 aa, Homo sapiens
PASSRLWGAP

SEQ ID NO: 1819 - protein, 10 aa, Homo sapiens
LTDLAQWEPV

SEQ ID NO: 1820 - protein, 10 aa, Homo sapiens
SVPLLTDLAQ

SEQ ID NO: 1821 - protein, 10 aa, Homo sapiens
VPLLTDLAQW

SEQ ID NO: 1822 - protein, 10 aa, Homo sapiens
QASVPLLTDL

SEQ ID NO: 1823 - protein, 10 aa, Homo sapiens
DLAQWEPVLV

SEQ ID NO: 1824 - protein, 10 aa, Homo sapiens
LLTDLAQWEP

SEQ ID NO: 1825 - protein, 10 aa, Homo sapiens
TDLAQWEPVL

SEQ ID NO: 1826 - protein, 10 aa, Homo sapiens
ASVPLLTDLA

SEQ ID NO: 1827 - protein, 10 aa, Homo sapiens
PLLTDLAQWE

SEQ ID NO: 1828 - protein, 10 aa, Homo sapiens
HLAQWEPVLV

SEQ ID NO: 1829 - protein, 10 aa, Homo sapiens
LLTHLAQWEP

SEQ ID NO: 1830 - protein, 10 aa, Homo sapiens
LTHLAQWEPV

SEQ ID NO: 1831 - protein, 10 aa, Homo sapiens
QASVPLLTHL

SEQ ID NO: 1832 - protein, 10 aa, Homo sapiens
VPLLTHLAQW

SEQ ID NO: 1833 - protein, 10 aa, Homo sapiens
SVPLLTHLAQ

SEQ ID NO: 1834 - protein, 10 aa, Homo sapiens
PLLTHLAQWE

SEQ ID NO: 1835 - protein, 10 aa, Homo sapiens
THLAQWEPVL

SEQ ID NO: 1836 - protein, 10 aa, Homo sapiens
ASVPLLTHLA

SEQ ID NO: 1837 - protein, 10 aa, Homo sapiens
LAQWEPVLVP

SEQ ID NO: 1838 - protein, 10 aa, Homo sapiens
TMYVCTPVPH

SEQ ID NO: 1839 - protein, 10 aa, Homo sapiens
SLTMYVCTPV

SEQ ID NO: 1840 - protein, 10 aa, Homo sapiens
TPVPHPDPPM

SEQ ID NO: 1841 - protein, 10 aa, Homo sapiens
YVCTPVPHPD

SEQ ID NO: 1842 - protein, 10 aa, Homo sapiens
LTMYVCTPVP

SEQ ID NO: 1843 - protein, 10 aa, Homo sapiens
ASLTMYVCTP

SEQ ID NO: 1844 - protein, 10 aa, Homo sapiens
CTPVPHPDPP

SEQ ID NO: 1845 - protein, 10 aa, Homo sapiens
NASLTMYVCT

SEQ ID NO: 1846 - protein, 10 aa, Homo sapiens
VCTPVPHPDP

SEQ ID NO: 1847 - protein, 10 aa, Homo sapiens
MYVCTPVPHP

SEQ ID NO: 1848 - protein, 10 aa, Homo sapiens
RTPTRQISSI

SEQ ID NO: 1849 - protein, 10 aa, Homo sapiens
QISSIDTDPP

SEQ ID NO: 1850 - protein, 10 aa, Homo sapiens
RQISSIDTDP

SEQ ID NO: 1851 - protein, 10 aa, Homo sapiens
ISSIDTDPPA

SEQ ID NO: 1852 - protein, 10 aa, Homo sapiens
PTRQISSIDT

SEQ ID NO: 1853 - protein, 10 aa, Homo sapiens
TPTRQISSID

SEQ ID NO: 1854 - protein, 10 aa, Homo sapiens
LSRTPTRQIS

SEQ ID NO: 1855 - protein, 10 aa, Homo sapiens
SSIDTDPPAD

SEQ ID NO: 1856 - protein, 10 aa, Homo sapiens
SRTPTRQISS

SEQ ID NO: 1857 - protein, 10 aa, Homo sapiens
TRQISSIDTD

SEQ ID NO: 1858 - protein, 10 aa, Homo sapiens
RTPTRQISSS

SEQ ID NO: 1859 - protein, 10 aa, Homo sapiens
QISSSDTDPP

SEQ ID NO: 1860 - protein, 10 aa, Homo sapiens
ISSSDTDPPA

SEQ ID NO: 1861 - protein, 10 aa, Homo sapiens
RQISSSDTDP

SEQ ID NO: 1862 - protein, 10 aa, Homo sapiens
PTRQISSSDT

SEQ ID NO: 1863 - protein, 10 aa, Homo sapiens
TPTRQISSSD

SEQ ID NO: 1864 - protein, 10 aa, Homo sapiens
SSSDTDPPAD

SEQ ID NO: 1865 - protein, 10 aa, Homo sapiens
TRQISSSDTD

SEQ ID NO: 1866 - protein, 10 aa, Homo sapiens
QIGSSDTDPP

SEQ ID NO: 1867 - protein, 10 aa, Homo sapiens
RQIGSSDTDP

SEQ ID NO: 1868 - protein, 10 aa, Homo sapiens
RTPTRQIGSS

SEQ ID NO: 1869 - protein, 10 aa, Homo sapiens
PTRQIGSSDT

SEQ ID NO: 1870 - protein, 10 aa, Homo sapiens
GSSDTDPPAD

SEQ ID NO: 1871 - protein, 10 aa, Homo sapiens
TPTRQIGSSD

SEQ ID NO: 1872 - protein, 10 aa, Homo sapiens
IGSSDTDPPA

SEQ ID NO: 1873 - protein, 10 aa, Homo sapiens
SSDTDPPADG

SEQ ID NO: 1874 - protein, 10 aa, Homo sapiens
SDTDPPADGP

SEQ ID NO: 1875 - protein, 10 aa, Homo sapiens
TRQIGSSDTD

SEQ ID NO: 1876 - protein, 10 aa, Homo sapiens
PSRGQALRRA

SEQ ID NO: 1877 - protein, 10 aa, Homo sapiens
SRGQALRRAQ

SEQ ID NO: 1878 - protein, 9 aa, Homo sapiens
SQDYYVGKK

SEQ ID NO: 1879 - protein, 9 aa, Homo sapiens
TALLCYSCK

SEQ ID NO: 1880 - protein, 9 aa, Homo sapiens
VGLLTVISK

SEQ ID NO: 1881 - protein, 9 aa, Homo sapiens
AVLLALLMA

SEQ ID NO: 1882 - protein, 9 aa, Homo sapiens
TVISKGCSL

SEQ ID NO: 1883 - protein, 9 aa, Homo sapiens
CVDDSQDYY

SEQ ID NO: 1884 - protein, 9 aa, Homo sapiens
KAVLLALLM

SEQ ID NO: 1885 - protein, 9 aa, Homo sapiens
GLALQPGTA

SEQ ID NO: 1886 - protein, 9 aa, Homo sapiens
ALLMAGLAL

SEQ ID NO: 1887 - protein, 9 aa, Homo sapiens
LQPAAAILA

SEQ ID NO: 1888 - protein, 9 aa, Homo sapiens
CTQLGEQCW

SEQ ID NO: 1889 - protein, 9 aa, Homo sapiens
LQVENCTQL

SEQ ID NO: 1890 - protein, 9 aa, Homo sapiens
AQVSNEDCL

SEQ ID NO: 1891 - protein, 9 aa, Homo sapiens
RAVGLLTVI

SEQ ID NO: 1892 - protein, 9 aa, Homo sapiens
QCWTARIRA

SEQ ID NO: 1893 - protein, 9 aa, Homo sapiens
QLGEQCWTA

SEQ ID NO: 1894 - protein, 9 aa, Homo sapiens
LLPALGLLL

SEQ ID NO: 1895 - protein, 9 aa, Homo sapiens
ALLPALGLL

SEQ ID NO: 1896 - protein, 9 aa, Homo sapiens
DSQDYYVGK

SEQ ID NO: 1897 - protein, 9 aa, Homo sapiens
LLLWGPGQL

SEQ ID NO: 1898 - protein, 9 aa, Homo sapiens
LALLPALGL

SEQ ID NO: 1899 - protein, 9 aa, Homo sapiens
AAILALLPA

SEQ ID NO: 1900 - protein, 9 aa, Homo sapiens
ALLCYSCKA

SEQ ID NO: 1901 - protein, 9 aa, Homo sapiens
GAHALQPAA

SEQ ID NO: 1902 - protein, 9 aa, Homo sapiens
GTALLCYSC

SEQ ID NO: 1903 - protein, 9 aa, Homo sapiens
AILALLPAL

SEQ ID NO: 1904 - protein, 9 aa, Homo sapiens
LLALLMAGL

SEQ ID NO: 1905 - protein, 9 aa, Homo sapiens
LGEQCWTAR

SEQ ID NO: 1906 - protein, 9 aa, Homo sapiens
NITCCDTDL

SEQ ID NO: 1907 - protein, 9 aa, Homo sapiens
LCYSCKAQV

SEQ ID NO: 1908 - protein, 9 aa, Homo sapiens
LPALGLLLW

SEQ ID NO: 1909 - protein, 9 aa, Homo sapiens
ALQPAAAIL

SEQ ID NO: 1910 - protein, 9 aa, Homo sapiens
QPAAAILAL

SEQ ID NO: 1911 - protein, 9 aa, Homo sapiens
YVGKKNITC

SEQ ID NO: 1912 - protein, 9 aa, Homo sapiens
ALQPGTALL

SEQ ID NO: 1913 - protein, 9 aa, Homo sapiens
QPGTALLCY

SEQ ID NO: 1914 - protein, 9 aa, Homo sapiens
EQCWTARIR

SEQ ID NO: 1915 - protein, 9 aa, Homo sapiens
LALQPGTAL

SEQ ID NO: 1916 - protein, 9 aa, Homo sapiens
LALLMAGLA

SEQ ID NO: 1917 - protein, 9 aa, Homo sapiens
NCVDDSQDY

SEQ ID NO: 1918 - protein, 9 aa, Homo sapiens
HALQPAAAI

SEQ ID NO: 1919 - protein, 9 aa, Homo sapiens
RIRAVGLLT

SEQ ID NO: 1920 - protein, 9 aa, Homo sapiens
QVSNEDCLQ

SEQ ID NO: 1921 - protein, 9 aa, Homo sapiens
LCNASGAHA

SEQ ID NO: 1922 - protein, 9 aa, Homo sapiens
TARIRAVGL

SEQ ID NO: 1923 - protein, 9 aa, Homo sapiens
AVGLLTVIS

SEQ ID NO: 1924 - protein, 9 aa, Homo sapiens
QVENCTQLG

SEQ ID NO: 1925 - protein, 9 aa, Homo sapiens
CCDTDLCNA

SEQ ID NO: 1926 - protein, 9 aa, Homo sapiens
GLLTVISKG

SEQ ID NO: 1927 - protein, 9 aa, Homo sapiens
GLLLWGPGQ

SEQ ID NO: 1928 - protein, 9 aa, Homo sapiens
GEQCWTARI

SEQ ID NO: 1929 - protein, 9 aa, Homo sapiens
LTVISKGCS

SEQ ID NO: 1930 - protein, 9 aa, Homo sapiens
VLLALLMAG

SEQ ID NO: 1931 - protein, 9 aa, Homo sapiens
LQPGTALLC

SEQ ID NO: 1932 - protein, 9 aa, Homo sapiens
DLCNASGAH

SEQ ID NO: 1933 - protein, 9 aa, Homo sapiens
DYYVGKKNI

SEQ ID NO: 1934 - protein, 9 aa, Homo sapiens
ITCCDTDLC

SEQ ID NO: 1935 - protein, 9 aa, Homo sapiens
WTARIRAVG

SEQ ID NO: 1936 - protein, 9 aa, Homo sapiens
TQLGEQCWT

SEQ ID NO: 1937 - protein, 9 aa, Homo sapiens
ALGLLLWGP

SEQ ID NO: 1938 - protein, 9 aa, Homo sapiens
LMAGLALQP

SEQ ID NO: 1939 - protein, 9 aa, Homo sapiens
LLMAGLALQ

SEQ ID NO: 1940 - protein, 9 aa, Homo sapiens
YYVGKKNIT

SEQ ID NO: 1941 - protein, 9 aa, Homo sapiens
GCSLNCVDD

SEQ ID NO: 1942 - protein, 9 aa, Homo sapiens
KAQVSNEDC

SEQ ID NO: 1943 - protein, 9 aa, Homo sapiens
VSNEDCLQV

SEQ ID NO: 1944 - protein, 9 aa, Homo sapiens
CLQVENCTQ

SEQ ID NO: 1945 - protein, 9 aa, Homo sapiens
VDDSQDYYV

SEQ ID NO: 1946 - protein, 9 aa, Homo sapiens
VISKGCSLN

SEQ ID NO: 1947 - protein, 9 aa, Homo sapiens
ILALLPALG

SEQ ID NO: 1948 - protein, 9 aa, Homo sapiens
TCCDTDLCN

SEQ ID NO: 1949 - protein, 9 aa, Homo sapiens
CNASGAHAL

SEQ ID NO: 1950 - protein, 9 aa, Homo sapiens
IRAVGLLTV

SEQ ID NO: 1951 - protein, 9 aa, Homo sapiens
CYSCKAQVS

SEQ ID NO: 1952 - protein, 9 aa, Homo sapiens
SLNCVDDSQ

SEQ ID NO: 1953 - protein, 9 aa, Homo sapiens
AAAILALLP

SEQ ID NO: 1954 - protein, 9 aa, Homo sapiens
TDLCNASGA

SEQ ID NO: 1955 - protein, 9 aa, Homo sapiens
DTDLCNASG

SEQ ID NO: 1956 - protein, 9 aa, Homo sapiens
ARIRAVGLL

SEQ ID NO: 1957 - protein, 9 aa, Homo sapiens
LLTVISKGC

SEQ ID NO: 1958 - protein, 9 aa, Homo sapiens
NCTQLGEQC

SEQ ID NO: 1959 - protein, 9 aa, Homo sapiens
SKGCSLNCV

SEQ ID NO: 1960 - protein, 9 aa, Homo sapiens
NASGAHALQ

SEQ ID NO: 1961 - protein, 9 aa, Homo sapiens
MAGLALQPG

SEQ ID NO: 1962 - protein, 9 aa, Homo sapiens
LLCYSCKAQ

SEQ ID NO: 1963 - protein, 9 aa, Homo sapiens
SCKAQVSNE

SEQ ID NO: 1964 - protein, 9 aa, Homo sapiens
SGAHALQPA

SEQ ID NO: 1965 - protein, 9 aa, Homo sapiens
MKAVLLALL

SEQ ID NO: 1966 - protein, 9 aa, Homo sapiens
AHALQPAAA

SEQ ID NO: 1967 - protein, 9 aa, Homo sapiens
PAAAILALL

SEQ ID NO: 1968 - protein, 9 aa, Homo sapiens
KNITCCDTD

SEQ ID NO: 1969 - protein, 9 aa, Homo sapiens
VENCTQLGE

SEQ ID NO: 1970 - protein, 9 aa, Homo sapiens
DCLQVENCT

SEQ ID NO: 1971 - protein, 9 aa, Homo sapiens
GKKNITCCD

SEQ ID NO: 1972 - protein, 9 aa, Homo sapiens
KGCSLNCVD

SEQ ID NO: 1973 - protein, 9 aa, Homo sapiens
PALGLLLWG

SEQ ID NO: 1974 - protein, 9 aa, Homo sapiens
KKNITCCDT

SEQ ID NO: 1975 - protein, 9 aa, Homo sapiens
NEDCLQVEN

SEQ ID NO: 1976 - protein, 9 aa, Homo sapiens
LNCVDDSQD

SEQ ID NO: 1977 - protein, 9 aa, Homo sapiens
ASGAHALQP

SEQ ID NO: 1978 - protein, 9 aa, Homo sapiens
SVVSPAPSR

SEQ ID NO: 1979 - protein, 9 aa, Homo sapiens
TTWARRTSR

SEQ ID NO: 1980 - protein, 9 aa, Homo sapiens
MALSRTPTR

SEQ ID NO: 1981 - protein, 9 aa, Homo sapiens
APSRGQALR

SEQ ID NO: 1982 - protein, 9 aa, Homo sapiens
QVWSVVSPA

SEQ ID NO: 1983 - protein, 9 aa, Homo sapiens
STLNPVLRH

SEQ ID NO: 1984 - protein, 9 aa, Homo sapiens
LVPEAHPNA

SEQ ID NO: 1985 - protein, 9 aa, Homo sapiens
LTMYVCAPV

SEQ ID NO: 1986 - protein, 9 aa, Homo sapiens
VVPQASVPL

SEQ ID NO: 1987 - protein, 9 aa, Homo sapiens
SVPLLTHPA

SEQ ID NO: 1988 - protein, 9 aa, Homo sapiens
VTPTCATPA

SEQ ID NO: 1989 - protein, 9 aa, Homo sapiens
MTHRTTTWA

SEQ ID NO: 1990 - protein, 9 aa, Homo sapiens
GVVPQASVP

SEQ ID NO: 1991 - protein, 9 aa, Homo sapiens
THRTTTWAR

SEQ ID NO: 1992 - protein, 9 aa, Homo sapiens
LFPQEAFPA

SEQ ID NO: 1993 - protein, 9 aa, Homo sapiens
RTPTRQIGS

SEQ ID NO: 1994 - protein, 9 aa, Homo sapiens
APLQPTLGV

SEQ ID NO: 1995 - protein, 9 aa, Homo sapiens
MYVCAPVPH

SEQ ID NO: 1996 - protein, 9 aa, Homo sapiens
RLWGAPLQP

SEQ ID NO: 1997 - protein, 9 aa, Homo sapiens
HRTTTWARR

SEQ ID NO: 1998 - protein, 9 aa, Homo sapiens
QASVPLLTH

SEQ ID NO: 1999 - protein, 9 aa, Homo sapiens
FPAHPIYDL

SEQ ID NO: 2000 - protein, 9 aa, Homo sapiens
SYRLWGAPL

SEQ ID NO: 2001 - protein, 9 aa, Homo sapiens
CSRLPPSLR

SEQ ID NO: 2002 - protein, 9 aa, Homo sapiens
PAGPMPCSR

SEQ ID NO: 2003 - protein, 9 aa, Homo sapiens
CSGDPASYR

SEQ ID NO: 2004 - protein, 9 aa, Homo sapiens
FSTLNPVLR

SEQ ID NO: 2005 - protein, 9 aa, Homo sapiens
SLRCSLHSA

SEQ ID NO: 2006 - protein, 9 aa, Homo sapiens
RTSRAVTPT

SEQ ID NO: 2007 - protein, 9 aa, Homo sapiens
HPIYDLSQV

SEQ ID NO: 2008 - protein, 9 aa, Homo sapiens
RQIGSIDTD

SEQ ID NO: 2009 - protein, 9 aa, Homo sapiens
AQWEPVLVP

SEQ ID NO: 2010 - protein, 9 aa, Homo sapiens
TPTRQIGSI

SEQ ID NO: 2011 - protein, 9 aa, Homo sapiens
AVTPTCATP

SEQ ID NO: 2012 - protein, 9 aa, Homo sapiens
TCATPAGPM

SEQ ID NO: 2013 - protein, 9 aa, Homo sapiens
LPPSLRCSL

SEQ ID NO: 2014 - protein, 9 aa, Homo sapiens
YVCAPVPHP

SEQ ID NO: 2015 - protein, 9 aa, Homo sapiens
VPQASVPLL

SEQ ID NO: 2016 - protein, 9 aa, Homo sapiens
SACCSGDPA

SEQ ID NO: 2017 - protein, 9 aa, Homo sapiens
LTHPAQWEP

SEQ ID NO: 2018 - protein, 9 aa, Homo sapiens
AFSTLNPVL

SEQ ID NO: 2019 - protein, 9 aa, Homo sapiens
VPHPDPPMA

SEQ ID NO: 2020 - protein, 9 aa, Homo sapiens
HPNASLTMY

SEQ ID NO: 2021 - protein, 9 aa, Homo sapiens
SPAPSRGQA

SEQ ID NO: 2022 - protein, 9 aa, Homo sapiens
PVPHPDPPM

SEQ ID NO: 2023 - protein, 9 aa, Homo sapiens
HPAQWEPVL

SEQ ID NO: 2024 - protein, 9 aa, Homo sapiens
LCCCFHGPA

SEQ ID NO: 2025 - protein, 9 aa, Homo sapiens
CCSGDPASY

SEQ ID NO: 2026 - protein, 9 aa, Homo sapiens
ATPAGPMPC

SEQ ID NO: 2027 - protein, 9 aa, Homo sapiens
CCCFHGPAF

SEQ ID NO: 2028 - protein, 9 aa, Homo sapiens
FPQEAFPAH

SEQ ID NO: 2029 - protein, 9 aa, Homo sapiens
VVSPAPSRG

SEQ ID NO: 2030 - protein, 9 aa, Homo sapiens
PTLGVVPQA

SEQ ID NO: 2031 - protein, 9 aa, Homo sapiens
RGQALRRAR

SEQ ID NO: 2032 - protein, 9 aa, Homo sapiens
GPAFSTLNP

SEQ ID NO: 2033 - protein, 9 aa, Homo sapiens
EAFPAHPIY

SEQ ID NO: 2034 - protein, 9 aa, Homo sapiens
DLSQVWSVV

SEQ ID NO: 2035 - protein, 9 aa, Homo sapiens
GSIDTDPPA

SEQ ID NO: 2036 - protein, 9 aa, Homo sapiens
RHLFPQEAF

SEQ ID NO: 2037 - protein, 9 aa, Homo sapiens
NPLCCCFHG

SEQ ID NO: 2038 - protein, 9 aa, Homo sapiens
SQVWSVVSP

SEQ ID NO: 2039 - protein, 9 aa, Homo sapiens
RAVTPTCAT

SEQ ID NO: 2040 - protein, 9 aa, Homo sapiens
PVLRHLFPQ

SEQ ID NO: 2041 - protein, 9 aa, Homo sapiens
EPVLVPEAH

SEQ ID NO: 2042 - protein, 9 aa, Homo sapiens
PDPPMALSR

SEQ ID NO: 2043 - protein, 9 aa, Homo sapiens
PSRGQALRR

SEQ ID NO: 2044 - protein, 9 aa, Homo sapiens
PIYDLSQVW

SEQ ID NO: 2045 - protein, 9 aa, Homo sapiens
TMYVCAPVP

SEQ ID NO: 2046 - protein, 9 aa, Homo sapiens
HLFPQEAFP

SEQ ID NO: 2047 - protein, 9 aa, Homo sapiens
GAPLQPTLG

SEQ ID NO: 2048 - protein, 9 aa, Homo sapiens
VLVPEAHPN

SEQ ID NO: 2049 - protein, 9 aa, Homo sapiens
LQPTLGVVP

SEQ ID NO: 2050 - protein, 9 aa, Homo sapiens
YDLSQVWSV

SEQ ID NO: 2051 - protein, 9 aa, Homo sapiens
PLLTHPAQW

SEQ ID NO: 2052 - protein, 9 aa, Homo sapiens
GPSNPLCCC

SEQ ID NO: 2053 - protein, 9 aa, Homo sapiens
RCSLHSACC

SEQ ID NO: 2054 - protein, 9 aa, Homo sapiens
NPVLRHLFP

SEQ ID NO: 2055 - protein, 9 aa, Homo sapiens
CFHGPAFST

SEQ ID NO: 2056 - protein, 9 aa, Homo sapiens
WEPVLVPEA

SEQ ID NO: 2057 - protein, 9 aa, Homo sapiens
QEAFPAHPI

SEQ ID NO: 2058 - protein, 9 aa, Homo sapiens
NASLTMYVC

SEQ ID NO: 2059 - protein, 9 aa, Homo sapiens
SIDTDPPAD

SEQ ID NO: 2060 - protein, 9 aa, Homo sapiens
VLRHLFPQE

SEQ ID NO: 2061 - protein, 9 aa, Homo sapiens
LNPVLRHLF

SEQ ID NO: 2062 - protein, 9 aa, Homo sapiens
CCFHGPAFS

SEQ ID NO: 2063 - protein, 9 aa, Homo sapiens
SLHSACCSG

SEQ ID NO: 2064 - protein, 9 aa, Homo sapiens
QIGSIDTDP

SEQ ID NO: 2065 - protein, 9 aa, Homo sapiens
SGDPASYRL

SEQ ID NO: 2066 - protein, 9 aa, Homo sapiens
SNPLCCCFH

SEQ ID NO: 2067 - protein, 9 aa, Homo sapiens
ALSRTPTRQ

SEQ ID NO: 2068 - protein, 9 aa, Homo sapiens
SLTMYVCAP

SEQ ID NO: 2069 - protein, 9 aa, Homo sapiens
AFPAHPIYD

SEQ ID NO: 2070 - protein, 9 aa, Homo sapiens
PLQPTLGVV

SEQ ID NO: 2071 - protein, 9 aa, Homo sapiens
TLGVVPQAS

SEQ ID NO: 2072 - protein, 9 aa, Homo sapiens
TLNPVLRHL

SEQ ID NO: 2073 - protein, 9 aa, Homo sapiens
LLTHPAQWE

SEQ ID NO: 2074 - protein, 9 aa, Homo sapiens
AHPNASLTM

SEQ ID NO: 2075 - protein, 9 aa, Homo sapiens
IYDLSQVWS

SEQ ID NO: 2076 - protein, 9 aa, Homo sapiens
PASYRLWGA

SEQ ID NO: 2077 - protein, 9 aa, Homo sapiens
PAFSTLNPV

SEQ ID NO: 2078 - protein, 9 aa, Homo sapiens
CSRLLPSLR

SEQ ID NO: 2079 - protein, 9 aa, Homo sapiens
LLPSLRCSL

SEQ ID NO: 2080 - protein, 9 aa, Homo sapiens
LPSLRCSLH

SEQ ID NO: 2081 - protein, 9 aa, Homo sapiens
GPMPCSRLL

SEQ ID NO: 2082 - protein, 9 aa, Homo sapiens
MPCSRLLPS

SEQ ID NO: 2083 - protein, 9 aa, Homo sapiens
PCSRLLPSL

SEQ ID NO: 2084 - protein, 9 aa, Homo sapiens
RLLPSLRCS

SEQ ID NO: 2085 - protein, 9 aa, Homo sapiens
PMPCSRLLP

SEQ ID NO: 2086 - protein, 9 aa, Homo sapiens
SRLLPSLRC

SEQ ID NO: 2087 - protein, 9 aa, Homo sapiens
CSGDPASSR

SEQ ID NO: 2088 - protein, 9 aa, Homo sapiens
PASSRLWGA

SEQ ID NO: 2089 - protein, 9 aa, Homo sapiens
SSRLWGAPL

SEQ ID NO: 2090 - protein, 9 aa, Homo sapiens
CCSGDPASS

SEQ ID NO: 2091 - protein, 9 aa, Homo sapiens
SGDPASSRL

SEQ ID NO: 2092 - protein, 9 aa, Homo sapiens
DPASSRLWG

SEQ ID NO: 2093 - protein, 9 aa, Homo sapiens
GDPASSRLW

SEQ ID NO: 2094 - protein, 9 aa, Homo sapiens
SRLWGAPLQ

SEQ ID NO: 2095 - protein, 8 aa, Homo sapiens
SSRLWGAP

SEQ ID NO: 2096 - protein, 9 aa, Homo sapiens
SVPLLTDPA

SEQ ID NO: 2097 - protein, 9 aa, Homo sapiens
LTDPAQWEP

SEQ ID NO: 2098 - protein, 9 aa, Homo sapiens
PLLTDPAQW

SEQ ID NO: 2099 - protein, 9 aa, Homo sapiens
DPAQWEPVL

SEQ ID NO: 2100 - protein, 9 aa, Homo sapiens
LLTDPAQWE

SEQ ID NO: 2101 - protein, 9 aa, Homo sapiens
QASVPLLTD

SEQ ID NO: 2102 - protein, 9 aa, Homo sapiens
VPLLTDPAQ

SEQ ID NO: 2103 - protein, 9 aa, Homo sapiens
TDPAQWEPV

SEQ ID NO: 2104 - protein, 9 aa, Homo sapiens
ASVPLLTDP

SEQ ID NO: 2105 - protein, 9 aa, Homo sapiens
SVPLLTDLA

SEQ ID NO: 2106 - protein, 9 aa, Homo sapiens
LTDLAQWEP

SEQ ID NO: 2107 - protein, 9 aa, Homo sapiens
DLAQWEPVL

SEQ ID NO: 2108 - protein, 9 aa, Homo sapiens
VPLLTDLAQ

SEQ ID NO: 2109 - protein, 9 aa, Homo sapiens
PLLTDLAQW

SEQ ID NO: 2110 - protein, 9 aa, Homo sapiens
LLTDLAQWE

SEQ ID NO: 2111 - protein, 9 aa, Homo sapiens
TDLAQWEPV

SEQ ID NO: 2112 - protein, 9 aa, Homo sapiens
ASVPLLTDL

SEQ ID NO: 2113 - protein, 9 aa, Homo sapiens
SVPLLTHLA

SEQ ID NO: 2114 - protein, 9 aa, Homo sapiens
HLAQWEPVL

SEQ ID NO: 2115 - protein, 9 aa, Homo sapiens
LAQWEPVLV

SEQ ID NO: 2116 - protein, 9 aa, Homo sapiens
LTHLAQWEP

SEQ ID NO: 2117 - protein, 9 aa, Homo sapiens
VPLLTHLAQ

SEQ ID NO: 2118 - protein, 9 aa, Homo sapiens
PLLTHLAQW

SEQ ID NO: 2119 - protein, 9 aa, Homo sapiens
LLTHLAQWE

SEQ ID NO: 2120 - protein, 9 aa, Homo sapiens
THLAQWEPV

SEQ ID NO: 2121 - protein, 9 aa, Homo sapiens
ASVPLLTHL

SEQ ID NO: 2122 - protein, 9 aa, Homo sapiens
LTMYVCTPV

SEQ ID NO: 2123 - protein, 9 aa, Homo sapiens
MYVCTPVPH

SEQ ID NO: 2124 - protein, 9 aa, Homo sapiens
YVCTPVPHP

SEQ ID NO: 2125 - protein, 9 aa, Homo sapiens
CTPVPHPDP

SEQ ID NO: 2126 - protein, 9 aa, Homo sapiens
TMYVCTPVP

SEQ ID NO: 2127 - protein, 9 aa, Homo sapiens
SLTMYVCTP

SEQ ID NO: 2128 - protein, 9 aa, Homo sapiens
VCTPVPHPD

SEQ ID NO: 2129 - protein, 8 aa, Homo sapiens
ASLTMYVC

SEQ ID NO: 2130 - protein, 9 aa, Homo sapiens
RTPTRQISS

SEQ ID NO: 2131 - protein, 9 aa, Homo sapiens
RQISSIDTD

SEQ ID NO: 2132 - protein, 9 aa, Homo sapiens
TPTRQISSI

SEQ ID NO: 2133 - protein, 9 aa, Homo sapiens
QISSIDTDP

SEQ ID NO: 2134 - protein, 9 aa, Homo sapiens
SSIDTDPPA

SEQ ID NO: 2135 - protein, 9 aa, Homo sapiens
PTRQISSID

SEQ ID NO: 2136 - protein, 9 aa, Homo sapiens
TRQISSIDT

SEQ ID NO: 2137 - protein, 9 aa, Homo sapiens
ISSIDTDPP

SEQ ID NO: 2138 - protein, 9 aa, Homo sapiens
SRTPTRQIS

SEQ ID NO: 2139 - protein, 9 aa, Homo sapiens
RQISSSDTD

SEQ ID NO: 2140 - protein, 9 aa, Homo sapiens
QISSSDTDP

SEQ ID NO: 2141 - protein, 9 aa, Homo sapiens
SSSDTDPPA

SEQ ID NO: 2142 - protein, 9 aa, Homo sapiens
TPTRQISSS

SEQ ID NO: 2143 - protein, 9 aa, Homo sapiens
PTRQISSSD

SEQ ID NO: 2144 - protein, 9 aa, Homo sapiens
TRQISSSDT

SEQ ID NO: 2145 - protein, 9 aa, Homo sapiens
ISSSDTDPP

SEQ ID NO: 2146 - protein, 9 aa, Homo sapiens
RQIGSSDTD

SEQ ID NO: 2147 - protein, 9 aa, Homo sapiens
GSSDTDPPA

SEQ ID NO: 2148 - protein, 9 aa, Homo sapiens
QIGSSDTDP

SEQ ID NO: 2149 - protein, 9 aa, Homo sapiens
TPTRQIGSS

SEQ ID NO: 2150 - protein, 9 aa, Homo sapiens
PTRQIGSSD

SEQ ID NO: 2151 - protein, 9 aa, Homo sapiens
IGSSDTDPP

SEQ ID NO: 2152 - protein, 9 aa, Homo sapiens
SSDTDPPAD

SEQ ID NO: 2153 - protein, 9 aa, Homo sapiens
TRQIGSSDT

SEQ ID NO: 2154 - protein, 9 aa, Homo sapiens
SDTDPPADG

SEQ ID NO: 2155 - protein, 9 aa, Homo sapiens
SRGQALRRA

SEQ ID NO: 2156 - protein, 9 aa, Homo sapiens
RGQALRRAQ

SEQ ID NO: 2157 - protein, 10 aa, Homo sapiens
AVGLLTVISK

SEQ ID NO: 2158 - protein, 10 aa, Homo sapiens
GTALLCYSCK

SEQ ID NO: 2159 - protein, 10 aa, Homo sapiens
QLGEQCWTAR

SEQ ID NO: 2160 - protein, 10 aa, Homo sapiens
QVSNEDCLQV

SEQ ID NO: 2161 - protein, 10 aa, Homo sapiens
CVDDSQDYYV

SEQ ID NO: 2162 - protein, 10 aa, Homo sapiens
RIRAVGLLTV

SEQ ID NO: 2163 - protein, 10 aa, Homo sapiens
GLLLWGPGQL

SEQ ID NO: 2164 - protein, 10 aa, Homo sapiens
KAVLLALLMA

SEQ ID NO: 2165 - protein, 10 aa, Homo sapiens
TQLGEQCWTA

SEQ ID NO: 2166 - protein, 10 aa, Homo sapiens
LTVISKGCSL

SEQ ID NO: 2167 - protein, 10 aa, Homo sapiens
GLALQPGTAL

SEQ ID NO: 2168 - protein, 10 aa, Homo sapiens
LQPAAAILAL

SEQ ID NO: 2169 - protein, 10 aa, Homo sapiens
ALLPALGLLL

SEQ ID NO: 2170 - protein, 10 aa, Homo sapiens
LQPGTALLCY

SEQ ID NO: 2171 - protein, 10 aa, Homo sapiens
WTARIRAVGL

SEQ ID NO: 2172 - protein, 10 aa, Homo sapiens
ILALLPALGL

SEQ ID NO: 2173 - protein, 10 aa, Homo sapiens
ALQPAAAILA

SEQ ID NO: 2174 - protein, 10 aa, Homo sapiens
LLPALGLLLW

SEQ ID NO: 2175 - protein, 10 aa, Homo sapiens
KAQVSNEDCL

SEQ ID NO: 2176 - protein, 10 aa, Homo sapiens
DSQDYYVGKK

SEQ ID NO: 2177 - protein, 10 aa, Homo sapiens
AVLLALLMAG

SEQ ID NO: 2178 - protein, 10 aa, Homo sapiens
LALLMAGLAL

SEQ ID NO: 2179 - protein, 10 aa, Homo sapiens
VLLALLMAGL

SEQ ID NO: 2180 - protein, 10 aa, Homo sapiens
GAHALQPAAA

SEQ ID NO: 2181 - protein, 10 aa, Homo sapiens
DDSQDYYVGK

SEQ ID NO: 2182 - protein, 10 aa, Homo sapiens
LLCYSCKAQV

SEQ ID NO: 2183 - protein, 10 aa, Homo sapiens
AAAILALLPA

SEQ ID NO: 2184 - protein, 10 aa, Homo sapiens
QVENCTQLGE

SEQ ID NO: 2185 - protein, 10 aa, Homo sapiens
CLQVENCTQL

SEQ ID NO: 2186 - protein, 10 aa, Homo sapiens
LLALLMAGLA

SEQ ID NO: 2187 - protein, 10 aa, Homo sapiens
EQCWTARIRA

SEQ ID NO: 2188 - protein, 10 aa, Homo sapiens
GEQCWTARIR

SEQ ID NO: 2189 - protein, 10 aa, Homo sapiens
TALLCYSCKA

SEQ ID NO: 2190 - protein, 10 aa, Homo sapiens
LALLPALGLL

SEQ ID NO: 2191 - protein, 10 aa, Homo sapiens
NCVDDSQDYY

SEQ ID NO: 2192 - protein, 10 aa, Homo sapiens
TVISKGCSLN

SEQ ID NO: 2193 - protein, 10 aa, Homo sapiens
AAILALLPAL

SEQ ID NO: 2194 - protein, 10 aa, Homo sapiens
LALQPGTALL

SEQ ID NO: 2195 - protein, 10 aa, Homo sapiens
HALQPAAAIL

SEQ ID NO: 2196 - protein, 10 aa, Homo sapiens
DTDLCNASGA

SEQ ID NO: 2197 - protein, 10 aa, Homo sapiens
ITCCDTDLCN

SEQ ID NO: 2198 - protein, 10 aa, Homo sapiens
LCNASGAHAL

SEQ ID NO: 2199 - protein, 10 aa, Homo sapiens
TCCDTDLCNA

SEQ ID NO: 2200 - protein, 10 aa, Homo sapiens
TARIRAVGLL

SEQ ID NO: 2201 - protein, 10 aa, Homo sapiens
YVGKKNITCC

SEQ ID NO: 2202 - protein, 10 aa, Homo sapiens
QPAAAILALL

SEQ ID NO: 2203 - protein, 10 aa, Homo sapiens
NCTQLGEQCW

SEQ ID NO: 2204 - protein, 10 aa, Homo sapiens
KNITCCDTDL

SEQ ID NO: 2205 - protein, 10 aa, Homo sapiens
LLMAGLALQP

SEQ ID NO: 2206 - protein, 10 aa, Homo sapiens
YYVGKKNITC

SEQ ID NO: 2207 - protein, 10 aa, Homo sapiens
DLCNASGAHA

SEQ ID NO: 2208 - protein, 10 aa, Homo sapiens
CTQLGEQCWT

SEQ ID NO: 2209 - protein, 10 aa, Homo sapiens
AQVSNEDCLQ

SEQ ID NO: 2210 - protein, 10 aa, Homo sapiens
RAVGLLTVIS

SEQ ID NO: 2211 - protein, 10 aa, Homo sapiens
LQVENCTQLG

SEQ ID NO: 2212 - protein, 10 aa, Homo sapiens
GLLTVISKGC

SEQ ID NO: 2213 - protein, 10 aa, Homo sapiens
ALQPGTALLC

SEQ ID NO: 2214 - protein, 10 aa, Homo sapiens
VISKGCSLNC

SEQ ID NO: 2215 - protein, 10 aa, Homo sapiens
GCSLNCVDDS

SEQ ID NO: 2216 - protein, 10 aa, Homo sapiens
AILALLPALG

SEQ ID NO: 2217 - protein, 10 aa, Homo sapiens
ALLMAGLALQ

SEQ ID NO: 2218 - protein, 10 aa, Homo sapiens
NITCCDTDLC

SEQ ID NO: 2219 - protein, 10 aa, Homo sapiens
QCWTARIRAV

SEQ ID NO: 2220 - protein, 10 aa, Homo sapiens
LNCVDDSQDY

SEQ ID NO: 2221 - protein, 10 aa, Homo sapiens
MKAVLLALLM

SEQ ID NO: 2222 - protein, 10 aa, Homo sapiens
LPALGLLLWG

SEQ ID NO: 2223 - protein, 10 aa, Homo sapiens
LMAGLALQPG

SEQ ID NO: 2224 - protein, 10 aa, Homo sapiens
LCYSCKAQVS

SEQ ID NO: 2225 - protein, 10 aa, Homo sapiens
CYSCKAQVSN

SEQ ID NO: 2226 - protein, 10 aa, Homo sapiens
SLNCVDDSQD

SEQ ID NO: 2227 - protein, 10 aa, Homo sapiens
ALGLLLWGPG

SEQ ID NO: 2228 - protein, 10 aa, Homo sapiens
LLTVISKGCS

SEQ ID NO: 2229 - protein, 10 aa, Homo sapiens
NASGAHALQP

SEQ ID NO: 2230 - protein, 10 aa, Homo sapiens
ALLCYSCKAQ

SEQ ID NO: 2231 - protein, 10 aa, Homo sapiens
SQDYYVGKKN

SEQ ID NO: 2232 - protein, 10 aa, Homo sapiens
AGLALQPGTA

SEQ ID NO: 2233 - protein, 10 aa, Homo sapiens
TDLCNASGAH

SEQ ID NO: 2234 - protein, 10 aa, Homo sapiens
DYYVGKKNIT

SEQ ID NO: 2235 - protein, 10 aa, Homo sapiens
QPGTALLCYS

SEQ ID NO: 2236 - protein, 10 aa, Homo sapiens
MAGLALQPGT

SEQ ID NO: 2237 - protein, 10 aa, Homo sapiens
CCDTDLCNAS

SEQ ID NO: 2238 - protein, 10 aa, Homo sapiens
QDYYVGKKNI

SEQ ID NO: 2239 - protein, 10 aa, Homo sapiens
ASGAHALQPA

SEQ ID NO: 2240 - protein, 10 aa, Homo sapiens
IRAVGLLTVI

SEQ ID NO: 2241 - protein, 10 aa, Homo sapiens
SGAHALQPAA

SEQ ID NO: 2242 - protein, 10 aa, Homo sapiens
ISKGCSLNCV

SEQ ID NO: 2243 - protein, 10 aa, Homo sapiens
AHALQPAAAI

SEQ ID NO: 2244 - protein, 10 aa, Homo sapiens
LGEQCWTARI

SEQ ID NO: 2245 - protein, 10 aa, Homo sapiens
SCKAQVSNED

SEQ ID NO: 2246 - protein, 10 aa, Homo sapiens
DCLQVENCTQ

SEQ ID NO: 2247 - protein, 10 aa, Homo sapiens
ARIRAVGLLT

SEQ ID NO: 2248 - protein, 10 aa, Homo sapiens
PALGLLLWGP

SEQ ID NO: 2249 - protein, 10 aa, Homo sapiens
KKNITCCDTD

SEQ ID NO: 2250 - protein, 10 aa, Homo sapiens
KGCSLNCVDD

SEQ ID NO: 2251 - protein, 10 aa, Homo sapiens
GKKNITCCDT

SEQ ID NO: 2252 - protein, 10 aa, Homo sapiens
NEDCLQVENC

SEQ ID NO: 2253 - protein, 10 aa, Homo sapiens
VENCTQLGEQ

SEQ ID NO: 2254 - protein, 10 aa, Homo sapiens
CNASGAHALQ

SEQ ID NO: 2255 - protein, 10 aa, Homo sapiens
PAAAILALLP

SEQ ID NO: 2256 - protein, 10 aa, Homo sapiens
SNEDCLQVEN

SEQ ID NO: 2257 - protein, 10 aa, Homo sapiens
MTHRTTTWAR

SEQ ID NO: 2258 - protein, 10 aa, Homo sapiens
TTTWARRTSR

SEQ ID NO: 2259 - protein, 10 aa, Homo sapiens
GVVPQASVPL

SEQ ID NO: 2260 - protein, 10 aa, Homo sapiens
APSRGQALRR

SEQ ID NO: 2261 - protein, 10 aa, Homo sapiens
HPDPPMALSR

SEQ ID NO: 2262 - protein, 10 aa, Homo sapiens
AFSTLNPVLR

SEQ ID NO: 2263 - protein, 10 aa, Homo sapiens
CCSGDPASYR

SEQ ID NO: 2264 - protein, 10 aa, Homo sapiens
TPAGPMPCSR

SEQ ID NO: 2265 - protein, 10 aa, Homo sapiens
RTPTRQIGSI

SEQ ID NO: 2266 - protein, 10 aa, Homo sapiens
HLFPQEAFPA

SEQ ID NO: 2267 - protein, 10 aa, Homo sapiens
AVTPTCATPA

SEQ ID NO: 2268 - protein, 10 aa, Homo sapiens
TTWARRTSRA

SEQ ID NO: 2269 - protein, 10 aa, Homo sapiens
VVPQASVPLL

SEQ ID NO: 2270 - protein, 10 aa, Homo sapiens
RLPPSLRCSL

SEQ ID NO: 2271 - protein, 10 aa, Homo sapiens
GAPLQPTLGV

SEQ ID NO: 2272 - protein, 10 aa, Homo sapiens
LTHPAQWEPV

SEQ ID NO: 2273 - protein, 10 aa, Homo sapiens
SQVWSVVSPA

SEQ ID NO: 2274 - protein, 10 aa, Homo sapiens
TMYVCAPVPH

SEQ ID NO: 2275 - protein, 10 aa, Homo sapiens
PMALSRTPTR

SEQ ID NO: 2276 - protein, 10 aa, Homo sapiens
IYDLSQVWSV

SEQ ID NO: 2277 - protein, 10 aa, Homo sapiens
WSVVSPAPSR

SEQ ID NO: 2278 - protein, 10 aa, Homo sapiens
VLVPEAHPNA

SEQ ID NO: 2279 - protein, 10 aa, Homo sapiens
GPSNPLCCCF

SEQ ID NO: 2280 - protein, 10 aa, Homo sapiens
GPAFSTLNPV

SEQ ID NO: 2281 - protein, 10 aa, Homo sapiens
TLGVVPQASV

SEQ ID NO: 2282 - protein, 10 aa, Homo sapiens
TLNPVLRHLF

SEQ ID NO: 2283 - protein, 10 aa, Homo sapiens
QVWSVVSPAP

SEQ ID NO: 2284 - protein, 10 aa, Homo sapiens
VPHPDPPMAL

SEQ ID NO: 2285 - protein, 10 aa, Homo sapiens
PAPSRGQALR

SEQ ID NO: 2286 - protein, 10 aa, Homo sapiens
VLRHLFPQEA

SEQ ID NO: 2287 - protein, 10 aa, Homo sapiens
PCSRLPPSLR

SEQ ID NO: 2288 - protein, 10 aa, Homo sapiens
HPNASLTMYV

SEQ ID NO: 2289 - protein, 10 aa, Homo sapiens
SLTMYVCAPV

SEQ ID NO: 2290 - protein, 10 aa, Homo sapiens
AFPAHPIYDL

SEQ ID NO: 2291 - protein, 10 aa, Homo sapiens
THRTTTWARR

SEQ ID NO: 2292 - protein, 10 aa, Homo sapiens
HPIYDLSQVW

SEQ ID NO: 2293 - protein, 10 aa, Homo sapiens
APVPHPDPPM

SEQ ID NO: 2294 - protein, 10 aa, Homo sapiens
SVVSPAPSRG

SEQ ID NO: 2295 - protein, 10 aa, Homo sapiens
APLQPTLGVV

SEQ ID NO: 2296 - protein, 10 aa, Homo sapiens
RTSRAVTPTC

SEQ ID NO: 2297 - protein, 10 aa, Homo sapiens
VPLLTHPAQW

SEQ ID NO: 2298 - protein, 10 aa, Homo sapiens
RQIGSIDTDP

SEQ ID NO: 2299 - protein, 10 aa, Homo sapiens
GPMPCSRLPP

SEQ ID NO: 2300 - protein, 10 aa, Homo sapiens
RLWGAPLQPT

SEQ ID NO: 2301 - protein, 10 aa, Homo sapiens
SVPLLTHPAQ

SEQ ID NO: 2302 - protein, 10 aa, Homo sapiens
ACCSGDPASY

SEQ ID NO: 2303 - protein, 10 aa, Homo sapiens
NASLTMYVCA

SEQ ID NO: 2304 - protein, 10 aa, Homo sapiens
LTMYVCAPVP

SEQ ID NO: 2305 - protein, 10 aa, Homo sapiens
YVCAPVPHPD

SEQ ID NO: 2306 - protein, 10 aa, Homo sapiens
LVPEAHPNAS

SEQ ID NO: 2307 - protein, 10 aa, Homo sapiens
HPAQWEPVLV

SEQ ID NO: 2308 - protein, 10 aa, Homo sapiens
LPPSLRCSLH

SEQ ID NO: 2309 - protein, 10 aa, Homo sapiens
QPTLGVVPQA

SEQ ID NO: 2310 - protein, 10 aa, Homo sapiens
VPEAHPNASL

SEQ ID NO: 2311 - protein, 10 aa, Homo sapiens
MPCSRLPPSL

SEQ ID NO: 2312 - protein, 10 aa, Homo sapiens
PVPHPDPPMA

SEQ ID NO: 2313 - protein, 10 aa, Homo sapiens
LFPQEAFPAH

SEQ ID NO: 2314 - protein, 10 aa, Homo sapiens
SPAPSRGQAL

SEQ ID NO: 2315 - protein, 10 aa, Homo sapiens
CFHGPAFSTL

SEQ ID NO: 2316 - protein, 10 aa, Homo sapiens
LCCCFHGPAF

SEQ ID NO: 2317 - protein, 10 aa, Homo sapiens
STLNPVLRHL

SEQ ID NO: 2318 - protein, 10 aa, Homo sapiens
CCFHGPAFST

SEQ ID NO: 2319 - protein, 10 aa, Homo sapiens
PQASVPLLTH

SEQ ID NO: 2320 - protein, 10 aa, Homo sapiens
AQWEPVLVPE

SEQ ID NO: 2321 - protein, 10 aa, Homo sapiens
EAHPNASLTM

SEQ ID NO: 2322 - protein, 10 aa, Homo sapiens
DPASYRLWGA

SEQ ID NO: 2323 - protein, 10 aa, Homo sapiens
ATPAGPMPCS

SEQ ID NO: 2324 - protein, 10 aa, Homo sapiens
VTPTCATPAG

SEQ ID NO: 2325 - protein, 10 aa, Homo sapiens
PTCATPAGPM

SEQ ID NO: 2326 - protein, 10 aa, Homo sapiens
NPVLRHLFPQ

SEQ ID NO: 2327 - protein, 10 aa, Homo sapiens
RAVTPTCATP

SEQ ID NO: 2328 - protein, 10 aa, Homo sapiens
LLTHPAQWEP

SEQ ID NO: 2329 - protein, 10 aa, Homo sapiens
MYVCAPVPHP

SEQ ID NO: 2330 - protein, 10 aa, Homo sapiens
LQPTLGVVPQ

SEQ ID NO: 2331 - protein, 10 aa, Homo sapiens
RCSLHSACCS

SEQ ID NO: 2332 - protein, 10 aa, Homo sapiens
PQEAFPAHPI

SEQ ID NO: 2333 - protein, 10 aa, Homo sapiens
WEPVLVPEAH

SEQ ID NO: 2334 - protein, 10 aa, Homo sapiens
QEAFPAHPIY

SEQ ID NO: 2335 - protein, 10 aa, Homo sapiens
SRGQALRRAR

SEQ ID NO: 2336 - protein, 10 aa, Homo sapiens
SIDTDPPADG

SEQ ID NO: 2337 - protein, 10 aa, Homo sapiens
PLCCCFHGPA

SEQ ID NO: 2338 - protein, 10 aa, Homo sapiens
VPQASVPLLT

SEQ ID NO: 2339 - protein, 10 aa, Homo sapiens
FSTLNPVLRH

SEQ ID NO: 2340 - protein, 10 aa, Homo sapiens
CATPAGPMPC

SEQ ID NO: 2341 - protein, 10 aa, Homo sapiens
QIGSIDTDPP

SEQ ID NO: 2342 - protein, 10 aa, Homo sapiens
PAFSTLNPVL

SEQ ID NO: 2343 - protein, 10 aa, Homo sapiens
SLRCSLHSAC

SEQ ID NO: 2344 - protein, 10 aa, Homo sapiens
SYRLWGAPLQ

SEQ ID NO: 2345 - protein, 10 aa, Homo sapiens
ASYRLWGAPL

SEQ ID NO: 2346 - protein, 10 aa, Homo sapiens
SLHSACCSGD

SEQ ID NO: 2347 - protein, 10 aa, Homo sapiens
ALSRTPTRQI

SEQ ID NO: 2348 - protein, 10 aa, Homo sapiens
CSGDPASYRL

SEQ ID NO: 2349 - protein, 10 aa, Homo sapiens
ASVPLLTHPA

SEQ ID NO: 2350 - protein, 10 aa, Homo sapiens
RTTTWARRTS

SEQ ID NO: 2351 - protein, 10 aa, Homo sapiens
DTDPPADGPS

SEQ ID NO: 2352 - protein, 10 aa, Homo sapiens
YDLSQVWSVV

SEQ ID NO: 2353 - protein, 10 aa, Homo sapiens
PVLVPEAHPN

SEQ ID NO: 2354 - protein, 10 aa, Homo sapiens
NPLCCCFHGP

SEQ ID NO: 2355 - protein, 10 aa, Homo sapiens
PVLRHLFPQE

SEQ ID NO: 2356 - protein, 10 aa, Homo sapiens
MALSRTPTRQ

SEQ ID NO: 2357 - protein, 10 aa, Homo sapiens
RLLPSLRCSL

SEQ ID NO: 2358 - protein, 10 aa, Homo sapiens
LLPSLRCSLH

SEQ ID NO: 2359 - protein, 10 aa, Homo sapiens
PCSRLLPSLR

SEQ ID NO: 2360 - protein, 10 aa, Homo sapiens
GPMPCSRLLP

SEQ ID NO: 2361 - protein, 10 aa, Homo sapiens
MPCSRLLPSL

SEQ ID NO: 2362 - protein, 10 aa, Homo sapiens
LPSLRCSLHS

SEQ ID NO: 2363 - protein, 10 aa, Homo sapiens
PMPCSRLLPS

SEQ ID NO: 2364 - protein, 10 aa, Homo sapiens
CSRLLPSLRC

SEQ ID NO: 2365 - protein, 10 aa, Homo sapiens
AGPMPCSRLL

SEQ ID NO: 2366 - protein, 10 aa, Homo sapiens
SRLLPSLRCS

SEQ ID NO: 2367 - protein, 10 aa, Homo sapiens
CCSGDPASSR

SEQ ID NO: 2368 - protein, 10 aa, Homo sapiens
DPASSRLWGA

SEQ ID NO: 2369 - protein, 10 aa, Homo sapiens
ASSRLWGAPL

SEQ ID NO: 2370 - protein, 10 aa, Homo sapiens
ACCSGDPASS

SEQ ID NO: 2371 - protein, 10 aa, Homo sapiens
CSGDPASSRL

SEQ ID NO: 2372 - protein, 10 aa, Homo sapiens
GDPASSRLWG

SEQ ID NO: 2373 - protein, 10 aa, Homo sapiens
SRLWGAPLQP

SEQ ID NO: 2374 - protein, 10 aa, Homo sapiens
SGDPASSRLW

SEQ ID NO: 2375 - protein, 10 aa, Homo sapiens
PASSRLWGAP

SEQ ID NO: 2376 - protein, 10 aa, Homo sapiens
SSRLWGAPLQ

SEQ ID NO: 2377 - protein, 10 aa, Homo sapiens
LTDPAQWEPV

SEQ ID NO: 2378 - protein, 10 aa, Homo sapiens
VPLLTDPAQW

SEQ ID NO: 2379 - protein, 10 aa, Homo sapiens
SVPLLTDPAQ

SEQ ID NO: 2380 - protein, 10 aa, Homo sapiens
LLTDPAQWEP

SEQ ID NO: 2381 - protein, 10 aa, Homo sapiens
DPAQWEPVLV

SEQ ID NO: 2382 - protein, 10 aa, Homo sapiens
ASVPLLTDPA

SEQ ID NO: 2383 - protein, 10 aa, Homo sapiens
TDPAQWEPVL

SEQ ID NO: 2384 - protein, 10 aa, Homo sapiens
QASVPLLTDP

SEQ ID NO: 2385 - protein, 10 aa, Homo sapiens
PQASVPLLTD

SEQ ID NO: 2386 - protein, 10 aa, Homo sapiens
PLLTDPAQWE

SEQ ID NO: 2387 - protein, 10 aa, Homo sapiens
LTDLAQWEPV

SEQ ID NO: 2388 - protein, 10 aa, Homo sapiens
SVPLLTDLAQ

SEQ ID NO: 2389 - protein, 10 aa, Homo sapiens
VPLLTDLAQW

SEQ ID NO: 2390 - protein, 10 aa, Homo sapiens
QASVPLLTDL

SEQ ID NO: 2391 - protein, 10 aa, Homo sapiens
DLAQWEPVLV

SEQ ID NO: 2392 - protein, 10 aa, Homo sapiens
LLTDLAQWEP

SEQ ID NO: 2393 - protein, 10 aa, Homo sapiens
TDLAQWEPVL

SEQ ID NO: 2394 - protein, 10 aa, Homo sapiens
ASVPLLTDLA

SEQ ID NO: 2395 - protein, 10 aa, Homo sapiens
PLLTDLAQWE

SEQ ID NO: 2396 - protein, 10 aa, Homo sapiens
LTHLAQWEPV

SEQ ID NO: 2397 - protein, 10 aa, Homo sapiens
HLAQWEPVLV

SEQ ID NO: 2398 - protein, 10 aa, Homo sapiens
SVPLLTHLAQ

SEQ ID NO: 2399 - protein, 10 aa, Homo sapiens
VPLLTHLAQW

SEQ ID NO: 2400 - protein, 10 aa, Homo sapiens
QASVPLLTHL

SEQ ID NO: 2401 - protein, 10 aa, Homo sapiens
LLTHLAQWEP

SEQ ID NO: 2402 - protein, 10 aa, Homo sapiens
LAQWEPVLVP

SEQ ID NO: 2403 - protein, 10 aa, Homo sapiens
THLAQWEPVL

SEQ ID NO: 2404 - protein, 10 aa, Homo sapiens
ASVPLLTHLA

SEQ ID NO: 2405 - protein, 10 aa, Homo sapiens
PLLTHLAQWE

SEQ ID NO: 2406 - protein, 10 aa, Homo sapiens
TMYVCTPVPH

SEQ ID NO: 2407 - protein, 10 aa, Homo sapiens
SLTMYVCTPV

SEQ ID NO: 2408 - protein, 10 aa, Homo sapiens
TPVPHPDPPM

SEQ ID NO: 2409 - protein, 10 aa, Homo sapiens
LTMYVCTPVP

SEQ ID NO: 2410 - protein, 10 aa, Homo sapiens
YVCTPVPHPD

SEQ ID NO: 2411 - protein, 10 aa, Homo sapiens
CTPVPHPDPP

SEQ ID NO: 2412 - protein, 10 aa, Homo sapiens
MYVCTPVPHP

SEQ ID NO: 2413 - protein, 10 aa, Homo sapiens
VCTPVPHPDP

SEQ ID NO: 2414 - protein, 10 aa, Homo sapiens
NASLTMYVCT

SEQ ID NO: 2415 - protein, 10 aa, Homo sapiens
ASLTMYVCTP

SEQ ID NO: 2416 - protein, 10 aa, Homo sapiens
RTPTRQISSI

SEQ ID NO: 2417 - protein, 10 aa, Homo sapiens
RQISSIDTDP

SEQ ID NO: 2418 - protein, 10 aa, Homo sapiens
QISSIDTDPP

SEQ ID NO: 2419 - protein, 10 aa, Homo sapiens
ISSIDTDPPA

SEQ ID NO: 2420 - protein, 10 aa, Homo sapiens
PTRQISSIDT

SEQ ID NO: 2421 - protein, 10 aa, Homo sapiens
TPTRQISSID

SEQ ID NO: 2422 - protein, 10 aa, Homo sapiens
SRTPTRQISS

SEQ ID NO: 2423 - protein, 10 aa, Homo sapiens
SSIDTDPPAD

SEQ ID NO: 2424 - protein, 10 aa, Homo sapiens
TRQISSIDTD

SEQ ID NO: 2425 - protein, 10 aa, Homo sapiens
LSRTPTRQIS

SEQ ID NO: 2426 - protein, 10 aa, Homo sapiens
RTPTRQISSS

SEQ ID NO: 2427 - protein, 10 aa, Homo sapiens
RQISSSDTDP

SEQ ID NO: 2428 - protein, 10 aa, Homo sapiens
QISSSDTDPP

SEQ ID NO: 2429 - protein, 10 aa, Homo sapiens
ISSSDTDPPA

SEQ ID NO: 2430 - protein, 10 aa, Homo sapiens
TPTRQISSSD

SEQ ID NO: 2431 - protein, 10 aa, Homo sapiens
PTRQISSSDT

SEQ ID NO: 2432 - protein, 10 aa, Homo sapiens
TRQISSSDTD

SEQ ID NO: 2433 - protein, 10 aa, Homo sapiens
SSSDTDPPAD

SEQ ID NO: 2434 - protein, 10 aa, Homo sapiens
RTPTRQISSS

SEQ ID NO: 2435 - protein, 10 aa, Homo sapiens
RQISSSDTDP

SEQ ID NO: 2436 - protein, 10 aa, Homo sapiens
QISSSDTDPP

SEQ ID NO: 2437 - protein, 10 aa, Homo sapiens
ISSSDTDPPA

SEQ ID NO: 2438 - protein, 10 aa, Homo sapiens
TPTRQISSSD

SEQ ID NO: 2439 - protein, 10 aa, Homo sapiens
PTRQISSSDT

SEQ ID NO: 2440 - protein, 10 aa, Homo sapiens
TRQISSSDTD

SEQ ID NO: 2441 - protein, 10 aa, Homo sapiens
SSSDTDPPAD

SEQ ID NO: 2442 - protein, 10 aa, Homo sapiens
SRGQALRRAQ

SEQ ID NO: 2443 - protein, 10 aa, Homo sapiens
PSRGQALRRA

SEQ ID NO: 2444 - protein, 9 aa, Homo sapiens
DYYVGKKNI

SEQ ID NO: 2445 - protein, 9 aa, Homo sapiens
YYVGKKNIT

SEQ ID NO: 2446 - protein, 9 aa, Homo sapiens
LQVENCTQL

SEQ ID NO: 2447 - protein, 9 aa, Homo sapiens
ALLPALGLL

SEQ ID NO: 2448 - protein, 9 aa, Homo sapiens
ALQPAAAIL

SEQ ID NO: 2449 - protein, 9 aa, Homo sapiens
LLPALGLLL

SEQ ID NO: 2450 - protein, 9 aa, Homo sapiens
ALQPGTALL

SEQ ID NO: 2451 - protein, 9 aa, Homo sapiens
AILALLPAL

SEQ ID NO: 2452 - protein, 9 aa, Homo sapiens
TVISKGCSL

SEQ ID NO: 2453 - protein, 9 aa, Homo sapiens
CYSCKAQVS

SEQ ID NO: 2454 - protein, 9 aa, Homo sapiens
ALLMAGLAL

SEQ ID NO: 2455 - protein, 9 aa, Homo sapiens
LLLWGPGQL

SEQ ID NO: 2456 - protein, 9 aa, Homo sapiens
AQVSNEDCL

SEQ ID NO: 2457 - protein, 9 aa, Homo sapiens
LALQPGTAL

SEQ ID NO: 2458 - protein, 9 aa, Homo sapiens
LALLPALGL

SEQ ID NO: 2459 - protein, 9 aa, Homo sapiens
LLALLMAGL

SEQ ID NO: 2460 - protein, 9 aa, Homo sapiens
QPAAAILAL

SEQ ID NO: 2461 - protein, 9 aa, Homo sapiens
NITCCDTDL

SEQ ID NO: 2462 - protein, 9 aa, Homo sapiens
TARIRAVGL

SEQ ID NO: 2463 - protein, 9 aa, Homo sapiens
CNASGAHAL

SEQ ID NO: 2464 - protein, 9 aa, Homo sapiens
RAVGLLTVI

SEQ ID NO: 2465 - protein, 9 aa, Homo sapiens
KAVLLALLM

SEQ ID NO: 2466 - protein, 9 aa, Homo sapiens
HALQPAAAI

SEQ ID NO: 2467 - protein, 9 aa, Homo sapiens
ARIRAVGLL

SEQ ID NO: 2468 - protein, 9 aa, Homo sapiens
PAAAILALL

SEQ ID NO: 2469 - protein, 9 aa, Homo sapiens
MKAVLLALL

SEQ ID NO: 2470 - protein, 9 aa, Homo sapiens
KAQVSNEDC

SEQ ID NO: 2471 - protein, 9 aa, Homo sapiens
RIRAVGLLT

SEQ ID NO: 2472 - protein, 9 aa, Homo sapiens
DCLQVENCT

SEQ ID NO: 2473 - protein, 9 aa, Homo sapiens
NCVDDSQDY

SEQ ID NO: 2474 - protein, 9 aa, Homo sapiens
CTQLGEQCW

SEQ ID NO: 2475 - protein, 9 aa, Homo sapiens
VSNEDCLQV

SEQ ID NO: 2476 - protein, 9 aa, Homo sapiens
AGLALQPGT

SEQ ID NO: 2477 - protein, 9 aa, Homo sapiens
ALLCYSCKA

SEQ ID NO: 2478 - protein, 9 aa, Homo sapiens
GEQCWTARI

SEQ ID NO: 2479 - protein, 9 aa, Homo sapiens
LALLMAGLA

SEQ ID NO: 2480 - protein, 9 aa, Homo sapiens
TQLGEQCWT

SEQ ID NO: 2481 - protein, 9 aa, Homo sapiens
AVLLALLMA

SEQ ID NO: 2482 - protein, 9 aa, Homo sapiens
LTVISKGCS

SEQ ID NO: 2483 - protein, 9 aa, Homo sapiens
LQPAAAILA

SEQ ID NO: 2484 - protein, 9 aa, Homo sapiens
LQPGTALLC

SEQ ID NO: 2485 - protein, 9 aa, Homo sapiens
CSLNCVDDS

SEQ ID NO: 2486 - protein, 9 aa, Homo sapiens
AAILALLPA

SEQ ID NO: 2487 - protein, 9 aa, Homo sapiens
LCNASGAHA

SEQ ID NO: 2488 - protein, 9 aa, Homo sapiens
LLTVISKGC

SEQ ID NO: 2489 - protein, 9 aa, Homo sapiens
AVGLLTVIS

SEQ ID NO: 2490 - protein, 9 aa, Homo sapiens
TCCDTDLCN

SEQ ID NO: 2491 - protein, 9 aa, Homo sapiens
QLGEQCWTA

SEQ ID NO: 2492 - protein, 9 aa, Homo sapiens
GTALLCYSC

SEQ ID NO: 2493 - protein, 9 aa, Homo sapiens
NCTQLGEQC

SEQ ID NO: 2494 - protein, 9 aa, Homo sapiens
GAHALQPAA

SEQ ID NO: 2495 - protein, 9 aa, Homo sapiens
CVDDSQDYY

SEQ ID NO: 2496 - protein, 9 aa, Homo sapiens
SGAHALQPA

SEQ ID NO: 2497 - protein, 9 aa, Homo sapiens
LCYSCKAQV

SEQ ID NO: 2498 - protein, 9 aa, Homo sapiens
VISKGCSLN

SEQ ID NO: 2499 - protein, 9 aa, Homo sapiens
QCWTARIRA

SEQ ID NO: 2500 - protein, 9 aa, Homo sapiens
QPGTALLCY

SEQ ID NO: 2501 - protein, 9 aa, Homo sapiens
YVGKKNITC

SEQ ID NO: 2502 - protein, 9 aa, Homo sapiens
ITCCDTDLC

SEQ ID NO: 2503 - protein, 9 aa, Homo sapiens
CCDTDLCNA

SEQ ID NO: 2504 - protein, 9 aa, Homo sapiens
YSCKAQVSN

SEQ ID NO: 2505 - protein, 9 aa, Homo sapiens
CWTARIRAV

SEQ ID NO: 2506 - protein, 9 aa, Homo sapiens
LPALGLLLW

SEQ ID NO: 2507 - protein, 9 aa, Homo sapiens
ISKGCSLNC

SEQ ID NO: 2508 - protein, 9 aa, Homo sapiens
VGKKNITCC

SEQ ID NO: 2509 - protein, 9 aa, Homo sapiens
GLALQPGTA

SEQ ID NO: 2510 - protein, 9 aa, Homo sapiens
KNITCCDTD

SEQ ID NO: 2511 - protein, 9 aa, Homo sapiens
KKNITCCDT

SEQ ID NO: 2512 - protein, 9 aa, Homo sapiens
KGCSLNCVD

SEQ ID NO: 2513 - protein, 9 aa, Homo sapiens
GLLTVISKG

SEQ ID NO: 2514 - protein, 9 aa, Homo sapiens
SNEDCLQVE

SEQ ID NO: 2515 - protein, 9 aa, Homo sapiens
SLNCVDDSQ

SEQ ID NO: 2516 - protein, 9 aa, Homo sapiens
LGLLLWGPG

SEQ ID NO: 2517 - protein, 9 aa, Homo sapiens
QVENCTQLG

SEQ ID NO: 2518 - protein, 9 aa, Homo sapiens
VLLALLMAG

SEQ ID NO: 2519 - protein, 9 aa, Homo sapiens
DSQDYYVGK

SEQ ID NO: 2520 - protein, 9 aa, Homo sapiens
CDTDLCNAS

SEQ ID NO: 2521 - protein, 9 aa, Homo sapiens
QDYYVGKKN

SEQ ID NO: 2522 - protein, 9 aa, Homo sapiens
LGEQCWTAR

SEQ ID NO: 2523 - protein, 9 aa, Homo sapiens
TALLCYSCK

SEQ ID NO: 2524 - protein, 9 aa, Homo sapiens
GLLLWGPGQ

SEQ ID NO: 2525 - protein, 9 aa, Homo sapiens
TDLCNASGA

SEQ ID NO: 2526 - protein, 9 aa, Homo sapiens
LLMAGLALQ

SEQ ID NO: 2527 - protein, 9 aa, Homo sapiens
VGLLTVISK

SEQ ID NO: 2528 - protein, 9 aa, Homo sapiens
CLQVENCTQ

SEQ ID NO: 2529 - protein, 9 aa, Homo sapiens
WTARIRAVG

SEQ ID NO: 2530 - protein, 9 aa, Homo sapiens
NEDCLQVEN

SEQ ID NO: 2531 - protein, 9 aa, Homo sapiens
AAAILALLP

SEQ ID NO: 2532 - protein, 9 aa, Homo sapiens
ALGLLLWGP

SEQ ID NO: 2533 - protein, 9 aa, Homo sapiens
SKGCSLNCV

SEQ ID NO: 2534 - protein, 9 aa, Homo sapiens
LMAGLALQP

SEQ ID NO: 2535 - protein, 9 aa, Homo sapiens
MAGLALQPG

SEQ ID NO: 2536 - protein, 9 aa, Homo sapiens
PGTALLCYS

SEQ ID NO: 2537 - protein, 9 aa, Homo sapiens
ILALLPALG

SEQ ID NO: 2538 - protein, 9 aa, Homo sapiens
SQDYYVGKK

SEQ ID NO: 2539 - protein, 9 aa, Homo sapiens
ENCTQLGEQ

SEQ ID NO: 2540 - protein, 9 aa, Homo sapiens
QVSNEDCLQ

SEQ ID NO: 2541 - protein, 9 aa, Homo sapiens
LLCYSCKAQ

SEQ ID NO: 2542 - protein, 9 aa, Homo sapiens
AHALQPAAA

SEQ ID NO: 2543 - protein, 9 aa, Homo sapiens
SCKAQVSNE

SEQ ID NO: 2544 - protein, 9 aa, Homo sapiens
SYRLWGAPL

SEQ ID NO: 2545 - protein, 9 aa, Homo sapiens
AFSTLNPVL

SEQ ID NO: 2546 - protein, 9 aa, Homo sapiens
TLNPVLRHL

SEQ ID NO: 2547 - protein, 9 aa, Homo sapiens
LPPSLRCSL

SEQ ID NO: 2548 - protein, 9 aa, Homo sapiens
VVPQASVPL

SEQ ID NO: 2549 - protein, 9 aa, Homo sapiens
VPQASVPLL

SEQ ID NO: 2550 - protein, 9 aa, Homo sapiens
AGPMPCSRL

SEQ ID NO: 2551 - protein, 9 aa, Homo sapiens
WGAPLQPTL

SEQ ID NO: 2552 - protein, 9 aa, Homo sapiens
IYDLSQVWS

SEQ ID NO: 2553 - protein, 9 aa, Homo sapiens
SGDPASYRL

SEQ ID NO: 2554 - protein, 9 aa, Homo sapiens
FPAHPIYDL

SEQ ID NO: 2555 - protein, 9 aa, Homo sapiens
HPAQWEPVL

SEQ ID NO: 2556 - protein, 9 aa, Homo sapiens
LNPVLRHLF

SEQ ID NO: 2557 - protein, 9 aa, Homo sapiens
CCCFHGPAF

SEQ ID NO: 2558 - protein, 9 aa, Homo sapiens
TPTRQIGSI

SEQ ID NO: 2559 - protein, 9 aa, Homo sapiens
LSRTPTRQI

SEQ ID NO: 2560 - protein, 9 aa, Homo sapiens
LFPQEAFPA

SEQ ID NO: 2561 - protein, 9 aa, Homo sapiens
MYVCAPVPH

SEQ ID NO: 2562 - protein, 9 aa, Homo sapiens
PAPSRGQAL

SEQ ID NO: 2563 - protein, 9 aa, Homo sapiens
RHLFPQEAF

SEQ ID NO: 2564 - protein, 9 aa, Homo sapiens
FHGPAFSTL

SEQ ID NO: 2565 - protein, 9 aa, Homo sapiens
CFHGPAFST

SEQ ID NO: 2566 - protein, 9 aa, Homo sapiens
TCATPAGPM

SEQ ID NO: 2567 - protein, 9 aa, Homo sapiens
PCSRLPPSL

SEQ ID NO: 2568 - protein, 9 aa, Homo sapiens
PADGPSNPL

SEQ ID NO: 2569 - protein, 9 aa, Homo sapiens
PSNPLCCCF

SEQ ID NO: 2570 - protein, 9 aa, Homo sapiens
RLPPSLRCS

SEQ ID NO: 2571 - protein, 9 aa, Homo sapiens
RTPTRQIGS

SEQ ID NO: 2572 - protein, 9 aa, Homo sapiens
RAVTPTCAT

SEQ ID NO: 2573 - protein, 9 aa, Homo sapiens
LTMYVCAPV

SEQ ID NO: 2574 - protein, 9 aa, Homo sapiens
RTSRAVTPT

SEQ ID NO: 2575 - protein, 9 aa, Homo sapiens
RTTTWARRT

SEQ ID NO: 2576 - protein, 9 aa, Homo sapiens
RCSLHSACC

SEQ ID NO: 2577 - protein, 9 aa, Homo sapiens
LVPEAHPNA

SEQ ID NO: 2578 - protein, 9 aa, Homo sapiens
VLVPEAHPN

SEQ ID NO: 2579 - protein, 9 aa, Homo sapiens
VPEAHPNAS

SEQ ID NO: 2580 - protein, 9 aa, Homo sapiens
SVPLLTHPA

SEQ ID NO: 2581 - protein, 9 aa, Homo sapiens
GSIDTDPPA

SEQ ID NO: 2582 - protein, 9 aa, Homo sapiens
TLGVVPQAS

SEQ ID NO: 2583 - protein, 9 aa, Homo sapiens
APLQPTLGV

SEQ ID NO: 2584 - protein, 9 aa, Homo sapiens
ATPAGPMPC

SEQ ID NO: 2585 - protein, 9 aa, Homo sapiens
LSQVWSVVS

SEQ ID NO: 2586 - protein, 9 aa, Homo sapiens
LGVVPQASV

SEQ ID NO: 2587 - protein, 9 aa, Homo sapiens
WSVVSPAPS

SEQ ID NO: 2588 - protein, 9 aa, Homo sapiens
HPIYDLSQV

SEQ ID NO: 2589 - protein, 9 aa, Homo sapiens
DGPSNPLCC

SEQ ID NO: 2590 - protein, 9 aa, Homo sapiens
HGPAFSTLN

SEQ ID NO: 2591 - protein, 9 aa, Homo sapiens
DPPMALSRT

SEQ ID NO: 2592 - protein, 9 aa, Homo sapiens
HPNASLTMY

SEQ ID NO: 2593 - protein, 9 aa, Homo sapiens
DPPADGPSN

SEQ ID NO: 2594 - protein, 9 aa, Homo sapiens
CSLHSACCS

SEQ ID NO: 2595 - protein, 9 aa, Homo sapiens
VTPTCATPA

SEQ ID NO: 2596 - protein, 9 aa, Homo sapiens
ASLTMYVCA

SEQ ID NO: 2597 - protein, 9 aa, Homo sapiens
QVWSVVSPA

SEQ ID NO: 2598 - protein, 9 aa, Homo sapiens
DLSQVWSVV

SEQ ID NO: 2599 - protein, 9 aa, Homo sapiens
TSRAVTPTC

SEQ ID NO: 2600 - protein, 9 aa, Homo sapiens
EAHPNASLT

SEQ ID NO: 2601 - protein, 9 aa, Homo sapiens
HPDPPMALS

SEQ ID NO: 2602 - protein, 9 aa, Homo sapiens
EAFPAHPIY

SEQ ID NO: 2603 - protein, 9 aa, Homo sapiens
SPAPSRGQA

SEQ ID NO: 2604 - protein, 9 aa, Homo sapiens
VPHPDPPMA

SEQ ID NO: 2605 - protein, 9 aa, Homo sapiens
LWGAPLQPT

SEQ ID NO: 2606 - protein, 9 aa, Homo sapiens
SLRCSLHSA

SEQ ID NO: 2607 - protein, 9 aa, Homo sapiens
MPCSRLPPS

SEQ ID NO: 2608 - protein, 9 aa, Homo sapiens
TWARRTSRA

SEQ ID NO: 2609 - protein, 9 aa, Homo sapiens
SACCSGDPA

SEQ ID NO: 2610 - protein, 9 aa, Homo sapiens
NASLTMYVC

SEQ ID NO: 2611 - protein, 9 aa, Homo sapiens
TPAGPMPCS

SEQ ID NO: 2612 - protein, 9 aa, Homo sapiens
WARRTSRAV

SEQ ID NO: 2613 - protein, 9 aa, Homo sapiens
ACCSGDPAS

SEQ ID NO: 2614 - protein, 9 aa, Homo sapiens
TTTWARRTS

SEQ ID NO: 2615 - protein, 9 aa, Homo sapiens
MTHRTTTWA

SEQ ID NO: 2616 - protein, 9 aa, Homo sapiens
GPSNPLCCC

SEQ ID NO: 2617 - protein, 9 aa, Homo sapiens
CCSGDPASY

SEQ ID NO: 2618 - protein, 9 aa, Homo sapiens
LCCCFHGPA

SEQ ID NO: 2619 - protein, 9 aa, Homo sapiens
CCFHGPAFS

SEQ ID NO: 2620 - protein, 9 aa, Homo sapiens
QEAFPAHPI

SEQ ID NO: 2621 - protein, 9 aa, Homo sapiens
AHPNASLTM

SEQ ID NO: 2622 - protein, 9 aa, Homo sapiens
AFPAHPIYD

SEQ ID NO: 2623 - protein, 9 aa, Homo sapiens
PVPHPDPPM

SEQ ID NO: 2624 - protein, 9 aa, Homo sapiens
PHPDPPMAL

SEQ ID NO: 2625 - protein, 9 aa, Homo sapiens
PEAHPNASL

SEQ ID NO: 2626 - protein, 9 aa, Homo sapiens
RGQALRRAR

SEQ ID NO: 2627 - protein, 9 aa, Homo sapiens
RQIGSIDTD

SEQ ID NO: 2628 - protein, 9 aa, Homo sapiens
QWEPVLVPE

SEQ ID NO: 2629 - protein, 9 aa, Homo sapiens
ASVPLLTHP

SEQ ID NO: 2630 - protein, 9 aa, Homo sapiens
FPQEAFPAH

SEQ ID NO: 2631 - protein, 9 aa, Homo sapiens
PTLGVVPQA

SEQ ID NO: 2632 - protein, 9 aa, Homo sapiens
EPVLVPEAH

SEQ ID NO: 2633 - protein, 9 aa, Homo sapiens
RLWGAPLQP

SEQ ID NO: 2634 - protein, 9 aa, Homo sapiens
WEPVLVPEA

SEQ ID NO: 2635 - protein, 9 aa, Homo sapiens
TDPPADGPS

SEQ ID NO: 2636 - protein, 9 aa, Homo sapiens
PLQPTLGVV

SEQ ID NO: 2637 - protein, 9 aa, Homo sapiens
SRLPPSLRC

SEQ ID NO: 2638 - protein, 9 aa, Homo sapiens
GPMPCSRLP

SEQ ID NO: 2639 - protein, 9 aa, Homo sapiens
LQPTLGVVP

SEQ ID NO: 2640 - protein, 9 aa, Homo sapiens
GVVPQASVP

SEQ ID NO: 2641 - protein, 9 aa, Homo sapiens
APVPHPDPP

SEQ ID NO: 2642 - protein, 9 aa, Homo sapiens
PIYDLSQVW

SEQ ID NO: 2643 - protein, 9 aa, Homo sapiens
VCAPVPHPD

SEQ ID NO: 2644 - protein, 9 aa, Homo sapiens
GPMPCSRLL

SEQ ID NO: 2645 - protein, 9 aa, Homo sapiens
LLPSLRCSL

SEQ ID NO: 2646 - protein, 9 aa, Homo sapiens
PCSRLLPSL

SEQ ID NO: 2647 - protein, 9 aa, Homo sapiens
RLLPSLRCS

SEQ ID NO: 2648 - protein, 9 aa, Homo sapiens
MPCSRLLPS

SEQ ID NO: 2649 - protein, 9 aa, Homo sapiens
SRLLPSLRC

SEQ ID NO: 2650 - protein, 9 aa, Homo sapiens
CSRLLPSLR

SEQ ID NO: 2651 - protein, 9 aa, Homo sapiens
LPSLRCSLH

SEQ ID NO: 2652 - protein, 9 aa, Homo sapiens
PMPCSRLLP

SEQ ID NO: 2653 - protein, 9 aa, Homo sapiens
SGDPASSRL

SEQ ID NO: 2654 - protein, 9 aa, Homo sapiens
SSRLWGAPL

SEQ ID NO: 2655 - protein, 9 aa, Homo sapiens
CCSGDPASS

SEQ ID NO: 2656 - protein, 9 aa, Homo sapiens
GDPASSRLW

SEQ ID NO: 2657 - protein, 9 aa, Homo sapiens
ASSRLWGAP

SEQ ID NO: 2658 - protein, 9 aa, Homo sapiens
CSGDPASSR

SEQ ID NO: 2659 - protein, 9 aa, Homo sapiens
PASSRLWGA

SEQ ID NO: 2660 - protein, 9 aa, Homo sapiens
DPASSRLWG

SEQ ID NO: 2661 - protein, 9 aa, Homo sapiens
SRLWGAPLQ

SEQ ID NO: 2662 - protein, 9 aa, Homo sapiens
DPAQWEPVL

SEQ ID NO: 2663 - protein, 9 aa, Homo sapiens
SVPLLTDPA

SEQ ID NO: 2664 - protein, 9 aa, Homo sapiens
ASVPLLTDP

SEQ ID NO: 2665 - protein, 9 aa, Homo sapiens
TDPAQWEPV

SEQ ID NO: 2666 - protein, 9 aa, Homo sapiens
PLLTDPAQW

SEQ ID NO: 2667 - protein, 9 aa, Homo sapiens
VPLLTDPAQ

SEQ ID NO: 2668 - protein, 9 aa, Homo sapiens
LLTDPAQWE

SEQ ID NO: 2669 - protein, 9 aa, Homo sapiens
LTDPAQWEP

SEQ ID NO: 2670 - protein, 9 aa, Homo sapiens
QASVPLLTD

SEQ ID NO: 2671 - protein, 9 aa, Homo sapiens
ASVPLLTDL

SEQ ID NO: 2672 - protein, 9 aa, Homo sapiens
DLAQWEPVL

SEQ ID NO: 2673 - protein, 9 aa, Homo sapiens
SVPLLTDLA

SEQ ID NO: 2674 - protein, 9 aa, Homo sapiens
LLTDLAQWE

SEQ ID NO: 2675 - protein, 9 aa, Homo sapiens
TDLAQWEPV

SEQ ID NO: 2676 - protein, 9 aa, Homo sapiens
VPLLTDLAQ

SEQ ID NO: 2677 - protein, 9 aa, Homo sapiens
PLLTDLAQW

SEQ ID NO: 2678 - protein, 9 aa, Homo sapiens
LTDLAQWEP

SEQ ID NO: 2679 - protein, 9 aa, Homo sapiens
ASVPLLTHL

SEQ ID NO: 2680 - protein, 9 aa, Homo sapiens
HLAQWEPVL

SEQ ID NO: 2681 - protein, 9 aa, Homo sapiens
SVPLLTHLA

SEQ ID NO: 2682 - protein, 9 aa, Homo sapiens
LAQWEPVLV

SEQ ID NO: 2683 - protein, 9 aa, Homo sapiens
VPLLTHLAQ

SEQ ID NO: 2684 - protein, 9 aa, Homo sapiens
PLLTHLAQW

SEQ ID NO: 2685 - protein, 9 aa, Homo sapiens
THLAQWEPV

SEQ ID NO: 2686 - protein, 9 aa, Homo sapiens
LLTHLAQWE

SEQ ID NO: 2687 - protein, 9 aa, Homo sapiens
LTHLAQWEP

SEQ ID NO: 2688 - protein, 9 aa, Homo sapiens
MYVCTPVPH

SEQ ID NO: 2689 - protein, 9 aa, Homo sapiens
LTMYVCTPV

SEQ ID NO: 2690 - protein, 9 aa, Homo sapiens
ASLTMYVCT

SEQ ID NO: 2691 - protein, 9 aa, Homo sapiens
VCTPVPHPD

SEQ ID NO: 2692 - protein, 9 aa, Homo sapiens
CTPVPHPDP

SEQ ID NO: 2693 - protein, 9 aa, Homo sapiens
TMYVCTPVP

SEQ ID NO: 2694 - protein, 9 aa, Homo sapiens
SLTMYVCTP

SEQ ID NO: 2695 - protein, 9 aa, Homo sapiens
YVCTPVPHP

SEQ ID NO: 2696 - protein, 9 aa, Homo sapiens
TPTRQISSI

SEQ ID NO: 2697 - protein, 9 aa, Homo sapiens
RTPTRQISS

SEQ ID NO: 2698 - protein, 9 aa, Homo sapiens
SSIDTDPPA

SEQ ID NO: 2699 - protein, 9 aa, Homo sapiens
RQISSIDTD

SEQ ID NO: 2700 - protein, 9 aa, Homo sapiens
TRQISSIDT

SEQ ID NO: 2701 - protein, 9 aa, Homo sapiens
SRTPTRQIS

SEQ ID NO: 2702 - protein, 9 aa, Homo sapiens
QISSIDTDP

SEQ ID NO: 2703 - protein, 9 aa, Homo sapiens
ISSIDTDPP

SEQ ID NO: 2704 - protein, 9 aa, Homo sapiens
PTRQISSID

SEQ ID NO: 2705 - protein, 8 aa, Homo sapiens
SSDTDPPA

SEQ ID NO: 2706 - protein, 9 aa, Homo sapiens
TPTRQISSS

SEQ ID NO: 2707 - protein, 9 aa, Homo sapiens
RQISSSDTD

SEQ ID NO: 2708 - protein, 9 aa, Homo sapiens
TRQISSSDT

SEQ ID NO: 2709 - protein, 9 aa, Homo sapiens
ISSSDTDPP

SEQ ID NO: 2710 - protein, 9 aa, Homo sapiens
QISSSDTDP

SEQ ID NO: 2711 - protein, 9 aa, Homo sapiens
PTRQISSSD

SEQ ID NO: 2712 - protein, 9 aa, Homo sapiens
GSSDTDPPA

SEQ ID NO: 2713 - protein, 9 aa, Homo sapiens
TPTRQIGSS

SEQ ID NO: 2714 - protein, 9 aa, Homo sapiens
RQIGSSDTD

SEQ ID NO: 2715 - protein, 9 aa, Homo sapiens
TRQIGSSDT

SEQ ID NO: 2716 - protein, 9 aa, Homo sapiens
SSDTDPPAD

SEQ ID NO: 2717 - protein, 9 aa, Homo sapiens
IGSSDTDPP

SEQ ID NO: 2718 - protein, 9 aa, Homo sapiens
QIGSSDTDP

SEQ ID NO: 2719 - protein, 9 aa, Homo sapiens
PTRQIGSSD

SEQ ID NO: 2720 - protein, 9 aa, Homo sapiens
SDTDPPADG

SEQ ID NO: 2721 - protein, 9 aa, Homo sapiens
RGQALRRAQ

SEQ ID NO: 2722 - protein, 9 aa, Homo sapiens
SRGQALRRA

SEQ ID NO: 2723 - protein, 10 aa, Homo sapiens
KNITCCDTDL

SEQ ID NO: 2724 - protein, 10 aa, Homo sapiens
KAQVSNEDCL

SEQ ID NO: 2725 - protein, 10 aa, Homo sapiens
ALLPALGLLL

SEQ ID NO: 2726 - protein, 10 aa, Homo sapiens
YYVGKKNITC

SEQ ID NO: 2727 - protein, 10 aa, Homo sapiens
VLLALLMAGL

SEQ ID NO: 2728 - protein, 10 aa, Homo sapiens
AAILALLPAL

SEQ ID NO: 2729 - protein, 10 aa, Homo sapiens
HALQPAAAIL

SEQ ID NO: 2730 - protein, 10 aa, Homo sapiens
DYYVGKKNIT

SEQ ID NO: 2731 - protein, 10 aa, Homo sapiens
LALLMAGLAL

SEQ ID NO: 2732 - protein, 10 aa, Homo sapiens
LCNASGAHAL

SEQ ID NO: 2733 - protein, 10 aa, Homo sapiens
CLQVENCTQL

SEQ ID NO: 2734 - protein, 10 aa, Homo sapiens
LQPAAAILAL

SEQ ID NO: 2735 - protein, 10 aa, Homo sapiens
LTVISKGCSL

SEQ ID NO: 2736 - protein, 10 aa, Homo sapiens
LALQPGTALL

SEQ ID NO: 2737 - protein, 10 aa, Homo sapiens
GLLLWGPGQL

SEQ ID NO: 2738 - protein, 10 aa, Homo sapiens
LALLPALGLL

SEQ ID NO: 2739 - protein, 10 aa, Homo sapiens
QPAAAILALL

SEQ ID NO: 2740 - protein, 10 aa, Homo sapiens
CYSCKAQVSN

SEQ ID NO: 2741 - protein, 10 aa, Homo sapiens
ILALLPALGL

SEQ ID NO: 2742 - protein, 10 aa, Homo sapiens
TARIRAVGLL

SEQ ID NO: 2743 - protein, 10 aa, Homo sapiens
WTARIRAVGL

SEQ ID NO: 2744 - protein, 10 aa, Homo sapiens
GLALQPGTAL

SEQ ID NO: 2745 - protein, 10 aa, Homo sapiens
LGEQCWTARI

SEQ ID NO: 2746 - protein, 10 aa, Homo sapiens
RAVGLLTVIS

SEQ ID NO: 2747 - protein, 10 aa, Homo sapiens
KAVLLALLMA

SEQ ID NO: 2748 - protein, 10 aa, Homo sapiens
SNEDCLQVEN

SEQ ID NO: 2749 - protein, 10 aa, Homo sapiens
GLLTVISKGC

SEQ ID NO: 2750 - protein, 10 aa, Homo sapiens
RIRAVGLLTV

SEQ ID NO: 2751 - protein, 10 aa, Homo sapiens
ALQPAAAILA

SEQ ID NO: 2752 - protein, 10 aa, Homo sapiens
NCVDDSQDYY

SEQ ID NO: 2753 - protein, 10 aa, Homo sapiens
ALQPGTALLC

SEQ ID NO: 2754 - protein, 10 aa, Homo sapiens
TALLCYSCKA

SEQ ID NO: 2755 - protein, 10 aa, Homo sapiens
SQDYYVGKKN

SEQ ID NO: 2756 - protein, 10 aa, Homo sapiens
LLPALGLLLW

SEQ ID NO: 2757 - protein, 10 aa, Homo sapiens
TVISKGCSLN

SEQ ID NO: 2758 - protein, 10 aa, Homo sapiens
LQPGTALLCY

SEQ ID NO: 2759 - protein, 10 aa, Homo sapiens
TQLGEQCWTA

SEQ ID NO: 2760 - protein, 10 aa, Homo sapiens
CTQLGEQCWT

SEQ ID NO: 2761 - protein, 10 aa, Homo sapiens
AGLALQPGTA

SEQ ID NO: 2762 - protein, 10 aa, Homo sapiens
CCDTDLCNAS

SEQ ID NO: 2763 - protein, 10 aa, Homo sapiens
TCCDTDLCNA

SEQ ID NO: 2764 - protein, 10 aa, Homo sapiens
ISKGCSLNCV

SEQ ID NO: 2765 - protein, 10 aa, Homo sapiens
CVDDSQDYYV

SEQ ID NO: 2766 - protein, 10 aa, Homo sapiens
ENCTQLGEQC

SEQ ID NO: 2767 - protein, 10 aa, Homo sapiens
LNCVDDSQDY

SEQ ID NO: 2768 - protein, 10 aa, Homo sapiens
NCTQLGEQCW

SEQ ID NO: 2769 - protein, 10 aa, Homo sapiens
IRAVGLLTVI

SEQ ID NO: 2770 - protein, 10 aa, Homo sapiens
ASGAHALQPA

SEQ ID NO: 2771 - protein, 10 aa, Homo sapiens
SGAHALQPAA

SEQ ID NO: 2772 - protein, 10 aa, Homo sapiens
LCYSCKAQVS

SEQ ID NO: 2773 - protein, 10 aa, Homo sapiens
QPGTALLCYS

SEQ ID NO: 2774 - protein, 10 aa, Homo sapiens
MAGLALQPGT

SEQ ID NO: 2775 - protein, 10 aa, Homo sapiens
QCWTARIRAV

SEQ ID NO: 2776 - protein, 10 aa, Homo sapiens
VISKGCSLNC

SEQ ID NO: 2777 - protein, 10 aa, Homo sapiens
AHALQPAAAI

SEQ ID NO: 2778 - protein, 10 aa, Homo sapiens
DTDLCNASGA

SEQ ID NO: 2779 - protein, 10 aa, Homo sapiens
YVGKKNITCC

SEQ ID NO: 2780 - protein, 10 aa, Homo sapiens
LLALLMAGLA

SEQ ID NO: 2781 - protein, 10 aa, Homo sapiens
QDYYVGKKNI

SEQ ID NO: 2782 - protein, 10 aa, Homo sapiens
ITCCDTDLCN

SEQ ID NO: 2783 - protein, 10 aa, Homo sapiens
NITCCDTDLC

SEQ ID NO: 2784 - protein, 10 aa, Homo sapiens
DLCNASGAHA

SEQ ID NO: 2785 - protein, 10 aa, Homo sapiens
LLTVISKGCS

SEQ ID NO: 2786 - protein, 10 aa, Homo sapiens
GCSLNCVDDS

SEQ ID NO: 2787 - protein, 10 aa, Homo sapiens
AAAILALLPA

SEQ ID NO: 2788 - protein, 10 aa, Homo sapiens
LLCYSCKAQV

SEQ ID NO: 2789 - protein, 10 aa, Homo sapiens
EQCWTARIRA

SEQ ID NO: 2790 - protein, 10 aa, Homo sapiens
GAHALQPAAA

SEQ ID NO: 2791 - protein, 10 aa, Homo sapiens
QVSNEDCLQV

SEQ ID NO: 2792 - protein, 10 aa, Homo sapiens
MKAVLLALLM

SEQ ID NO: 2793 - protein, 10 aa, Homo sapiens
VGLLTVISKG

SEQ ID NO: 2794 - protein, 10 aa, Homo sapiens
LQVENCTQLG

SEQ ID NO: 2795 - protein, 10 aa, Homo sapiens
VSNEDCLQVE

SEQ ID NO: 2796 - protein, 10 aa, Homo sapiens
ARIRAVGLLT

SEQ ID NO: 2797 - protein, 10 aa, Homo sapiens
CSLNCVDDSQ

SEQ ID NO: 2798 - protein, 10 aa, Homo sapiens
KGCSLNCVDD

SEQ ID NO: 2799 - protein, 10 aa, Homo sapiens
DSQDYYVGKK

SEQ ID NO: 2800 - protein, 10 aa, Homo sapiens
SCKAQVSNED

SEQ ID NO: 2801 - protein, 10 aa, Homo sapiens
LLMAGLALQP

SEQ ID NO: 2802 - protein, 10 aa, Homo sapiens
AVLLALLMAG

SEQ ID NO: 2803 - protein, 10 aa, Homo sapiens
AILALLPALG

SEQ ID NO: 2804 - protein, 10 aa, Homo sapiens
EDCLQVENCT

SEQ ID NO: 2805 - protein, 10 aa, Homo sapiens
ALLCYSCKAQ

SEQ ID NO: 2806 - protein, 10 aa, Homo sapiens
AQVSNEDCLQ

SEQ ID NO: 2807 - protein, 10 aa, Homo sapiens
SLNCVDDSQD

SEQ ID NO: 2808 - protein, 10 aa, Homo sapiens
LGLLLWGPGQ

SEQ ID NO: 2809 - protein, 10 aa, Homo sapiens
DCLQVENCTQ

SEQ ID NO: 2810 - protein, 10 aa, Homo sapiens
QVENCTQLGE

SEQ ID NO: 2811 - protein, 10 aa, Homo sapiens
ALLMAGLALQ

SEQ ID NO: 2812 - protein, 10 aa, Homo sapiens
CWTARIRAVG

SEQ ID NO: 2813 - protein, 10 aa, Homo sapiens
VGKKNITCCD

SEQ ID NO: 2814 - protein, 10 aa, Homo sapiens
ALGLLLWGPG

SEQ ID NO: 2815 - protein, 10 aa, Homo sapiens
PGTALLCYSC

SEQ ID NO: 2816 - protein, 10 aa, Homo sapiens
QLGEQCWTAR

SEQ ID NO: 2817 - protein, 10 aa, Homo sapiens
LMAGLALQPG

SEQ ID NO: 2818 - protein, 10 aa, Homo sapiens
LPALGLLLWG

SEQ ID NO: 2819 - protein, 10 aa, Homo sapiens
NEDCLQVENC

SEQ ID NO: 2820 - protein, 10 aa, Homo sapiens
NASGAHALQP

SEQ ID NO: 2821 - protein, 10 aa, Homo sapiens
CNASGAHALQ

SEQ ID NO: 2822 - protein, 10 aa, Homo sapiens
GKKNITCCDT

SEQ ID NO: 2823 - protein, 10 aa, Homo sapiens
AFPAHPIYDL

SEQ ID NO: 2824 - protein, 10 aa, Homo sapiens
CFHGPAFSTL

SEQ ID NO: 2825 - protein, 10 aa, Homo sapiens
RLPPSLRCSL

SEQ ID NO: 2826 - protein, 10 aa, Homo sapiens
STLNPVLRHL

SEQ ID NO: 2827 - protein, 10 aa, Homo sapiens
GVVPQASVPL

SEQ ID NO: 2828 - protein, 10 aa, Homo sapiens
VPEAHPNASL

SEQ ID NO: 2829 - protein, 10 aa, Homo sapiens
VVPQASVPLL

SEQ ID NO: 2830 - protein, 10 aa, Homo sapiens
SPAPSRGQAL

SEQ ID NO: 2831 - protein, 10 aa, Homo sapiens
IYDLSQVWSV

SEQ ID NO: 2832 - protein, 10 aa, Homo sapiens
VPHPDPPMAL

SEQ ID NO: 2833 - protein, 10 aa, Homo sapiens
MPCSRLPPSL

SEQ ID NO: 2834 - protein, 10 aa, Homo sapiens
CSGDPASYRL

SEQ ID NO: 2835 - protein, 10 aa, Homo sapiens
LWGAPLQPTL

SEQ ID NO: 2836 - protein, 10 aa, Homo sapiens
TLNPVLRHLF

SEQ ID NO: 2837 - protein, 10 aa, Homo sapiens
ASYRLWGAPL

SEQ ID NO: 2838 - protein, 10 aa, Homo sapiens
RTPTRQIGSI

SEQ ID NO: 2839 - protein, 10 aa, Homo sapiens
GPSNPLCCCF

SEQ ID NO: 2840 - protein, 10 aa, Homo sapiens
LCCCFHGPAF

SEQ ID NO: 2841 - protein, 10 aa, Homo sapiens
ALSRTPTRQI

SEQ ID NO: 2842 - protein, 10 aa, Homo sapiens
APVPHPDPPM

SEQ ID NO: 2843 - protein, 10 aa, Homo sapiens
MYVCAPVPHP

SEQ ID NO: 2844 - protein, 10 aa, Homo sapiens
THPAQWEPVL

SEQ ID NO: 2845 - protein, 10 aa, Homo sapiens
EAHPNASLTM

SEQ ID NO: 2846 - protein, 10 aa, Homo sapiens
PPADGPSNPL

SEQ ID NO: 2847 - protein, 10 aa, Homo sapiens
SYRLWGAPLQ

SEQ ID NO: 2848 - protein, 10 aa, Homo sapiens
PAFSTLNPVL

SEQ ID NO: 2849 - protein, 10 aa, Homo sapiens
PAGPMPCSRL

SEQ ID NO: 2850 - protein, 10 aa, Homo sapiens
RTSRAVTPTC

SEQ ID NO: 2851 - protein, 10 aa, Homo sapiens
RLWGAPLQPT

SEQ ID NO: 2852 - protein, 10 aa, Homo sapiens
QWEPVLVPEA

SEQ ID NO: 2853 - protein, 10 aa, Homo sapiens
LVPEAHPNAS

SEQ ID NO: 2854 - protein, 10 aa, Homo sapiens
ASVPLLTHPA

SEQ ID NO: 2855 - protein, 10 aa, Homo sapiens
HPIYDLSQVW

SEQ ID NO: 2856 - protein, 10 aa, Homo sapiens
VPQASVPLLT

SEQ ID NO: 2857 - protein, 10 aa, Homo sapiens
SQVWSVVSPA

SEQ ID NO: 2858 - protein, 10 aa, Homo sapiens
RTTTWARRTS

SEQ ID NO: 2859 - protein, 10 aa, Homo sapiens
RCSLHSACCS

SEQ ID NO: 2860 - protein, 10 aa, Homo sapiens
LRHLFPQEAF

SEQ ID NO: 2861 - protein, 10 aa, Homo sapiens
VLVPEAHPNA

SEQ ID NO: 2862 - protein, 10 aa, Homo sapiens
HPNASLTMYV

SEQ ID NO: 2863 - protein, 10 aa, Homo sapiens
VPLLTHPAQW

SEQ ID NO: 2864 - protein, 10 aa, Homo sapiens
GAPLQPTLGV

SEQ ID NO: 2865 - protein, 10 aa, Homo sapiens
PQEAFPAHPI

SEQ ID NO: 2866 - protein, 10 aa, Homo sapiens
APLQPTLGVV

SEQ ID NO: 2867 - protein, 10 aa, Homo sapiens
DGPSNPLCCC

SEQ ID NO: 2868 - protein, 10 aa, Homo sapiens
ATPAGPMPCS

SEQ ID NO: 2869 - protein, 10 aa, Homo sapiens
VSPAPSRGQA

SEQ ID NO: 2870 - protein, 10 aa, Homo sapiens
QPTLGVVPQA

SEQ ID NO: 2871 - protein, 10 aa, Homo sapiens
SLTMYVCAPV

SEQ ID NO: 2872 - protein, 10 aa, Homo sapiens
FPAHPIYDLS

SEQ ID NO: 2873 - protein, 10 aa, Homo sapiens
VLRHLFPQEA

SEQ ID NO: 2874 - protein, 10 aa, Homo sapiens
SGDPASYRLW

SEQ ID NO: 2875 - protein, 10 aa, Homo sapiens
DTDPPADGPS

SEQ ID NO: 2876 - protein, 10 aa, Homo sapiens
SLRCSLHSAC

SEQ ID NO: 2877 - protein, 10 aa, Homo sapiens
AVTPTCATPA

SEQ ID NO: 2878 - protein, 10 aa, Homo sapiens
CATPAGPMPC

SEQ ID NO: 2879 - protein, 10 aa, Homo sapiens
GPAFSTLNPV

SEQ ID NO: 2880 - protein, 10 aa, Homo sapiens
LTHPAQWEPV

SEQ ID NO: 2881 - protein, 10 aa, Homo sapiens
HLFPQEAFPA

SEQ ID NO: 2882 - protein, 10 aa, Homo sapiens
WARRTSRAVT

SEQ ID NO: 2883 - protein, 10 aa, Homo sapiens
CCCFHGPAFS

SEQ ID NO: 2884 - protein, 10 aa, Homo sapiens
SACCSGDPAS

SEQ ID NO: 2885 - protein, 10 aa, Homo sapiens
VWSVVSPAPS

SEQ ID NO: 2886 - protein, 10 aa, Homo sapiens
HPAQWEPVLV

SEQ ID NO: 2887 - protein, 10 aa, Homo sapiens
TTWARRTSRA

SEQ ID NO: 2888 - protein, 10 aa, Homo sapiens
DLSQVWSVVS

SEQ ID NO: 2889 - protein, 10 aa, Homo sapiens
CSRLPPSLRC

SEQ ID NO: 2890 - protein, 10 aa, Homo sapiens
HSACCSGDPA

SEQ ID NO: 2891 - protein, 10 aa, Homo sapiens
DPASYRLWGA

SEQ ID NO: 2892 - protein, 10 aa, Homo sapiens
IGSIDTDPPA

SEQ ID NO: 2893 - protein, 10 aa, Homo sapiens
ACCSGDPASY

SEQ ID NO: 2894 - protein, 10 aa, Homo sapiens
TLGVVPQASV

SEQ ID NO: 2895 - protein, 10 aa, Homo sapiens
CCFHGPAFST

SEQ ID NO: 2896 - protein, 10 aa, Homo sapiens
TSRAVTPTCA

SEQ ID NO: 2897 - protein, 10 aa, Homo sapiens
NASLTMYVCA

SEQ ID NO: 2898 - protein, 10 aa, Homo sapiens
TWARRTSRAV

SEQ ID NO: 2899 - protein, 10 aa, Homo sapiens
LFPQEAFPAH

SEQ ID NO: 2900 - protein, 10 aa, Homo sapiens
PTCATPAGPM

SEQ ID NO: 2901 - protein, 10 aa, Homo sapiens
AFSTLNPVLR

SEQ ID NO: 2902 - protein, 10 aa, Homo sapiens
RQIGSIDTDP

SEQ ID NO: 2903 - protein, 10 aa, Homo sapiens
RAVTPTCATP

SEQ ID NO: 2904 - protein, 10 aa, Homo sapiens
PTLGVVPQAS

SEQ ID NO: 2905 - protein, 10 aa, Homo sapiens
YDLSQVWSVV

SEQ ID NO: 2906 - protein, 10 aa, Homo sapiens
RRTSRAVTPT

SEQ ID NO: 2907 - protein, 10 aa, Homo sapiens
TDPPADGPSN

SEQ ID NO: 2908 - protein, 10 aa, Homo sapiens
SRLPPSLRCS

SEQ ID NO: 2909 - protein, 10 aa, Homo sapiens
GPMPCSRLPP

SEQ ID NO: 2910 - protein, 10 aa, Homo sapiens
FPQEAFPAHP

SEQ ID NO: 2911 - protein, 10 aa, Homo sapiens
DPPMALSRTP

SEQ ID NO: 2912 - protein, 10 aa, Homo sapiens
NPLCCCFHGP

SEQ ID NO: 2913 - protein, 10 aa, Homo sapiens
GSIDTDPPAD

SEQ ID NO: 2914 - protein, 10 aa, Homo sapiens
AQWEPVLVPE

SEQ ID NO: 2915 - protein, 10 aa, Homo sapiens
PVPHPDPPMA

SEQ ID NO: 2916 - protein, 10 aa, Homo sapiens
AGPMPCSRLP

SEQ ID NO: 2917 - protein, 10 aa, Homo sapiens
LTMYVCAPVP

SEQ ID NO: 2918 - protein, 10 aa, Homo sapiens
CAPVPHPDPP

SEQ ID NO: 2919 - protein, 10 aa, Homo sapiens
HGPAFSTLNP

SEQ ID NO: 2920 - protein, 10 aa, Homo sapiens
PSLRCSLHSA

SEQ ID NO: 2921 - protein, 10 aa, Homo sapiens
PPMALSRTPT

SEQ ID NO: 2922 - protein, 10 aa, Homo sapiens
LNPVLRHLFP

SEQ ID NO: 2923 - protein, 10 aa, Homo sapiens
RLLPSLRCSL

SEQ ID NO: 2924 - protein, 10 aa, Homo sapiens
AGPMPCSRLL

SEQ ID NO: 2925 - protein, 10 aa, Homo sapiens
MPCSRLLPSL

SEQ ID NO: 2926 - protein, 10 aa, Homo sapiens
CSRLLPSLRC

SEQ ID NO: 2927 - protein, 10 aa, Homo sapiens
LPSLRCSLHS

SEQ ID NO: 2928 - protein, 10 aa, Homo sapiens
GPMPCSRLLP

SEQ ID NO: 2929 - protein, 10 aa, Homo sapiens
SRLLPSLRCS

SEQ ID NO: 2930 - protein, 10 aa, Homo sapiens
PMPCSRLLPS

SEQ ID NO: 2931 - protein, 10 aa, Homo sapiens
LLPSLRCSLH

SEQ ID NO: 2932 - protein, 10 aa, Homo sapiens
PCSRLLPSLR

SEQ ID NO: 2933 - protein, 10 aa, Homo sapiens
CSGDPASSRL

SEQ ID NO: 2934 - protein, 10 aa, Homo sapiens
ASSRLWGAPL

SEQ ID NO: 2935 - protein, 10 aa, Homo sapiens
SGDPASSRLW

SEQ ID NO: 2936 - protein, 10 aa, Homo sapiens
DPASSRLWGA

SEQ ID NO: 2937 - protein, 10 aa, Homo sapiens
ACCSGDPASS

SEQ ID NO: 2938 - protein, 10 aa, Homo sapiens
SSRLWGAPLQ

SEQ ID NO: 2939 - protein, 10 aa, Homo sapiens
CCSGDPASSR

SEQ ID NO: 2940 - protein, 10 aa, Homo sapiens
SRLWGAPLQP

SEQ ID NO: 2941 - protein, 10 aa, Homo sapiens
GDPASSRLWG

SEQ ID NO: 2942 - protein, 10 aa, Homo sapiens
PASSRLWGAP

SEQ ID NO: 2943 - protein, 10 aa, Homo sapiens
TDPAQWEPVL

SEQ ID NO: 2944 - protein, 10 aa, Homo sapiens
ASVPLLTDPA

SEQ ID NO: 2945 - protein, 10 aa, Homo sapiens
VPLLTDPAQW

SEQ ID NO: 2946 - protein, 10 aa, Homo sapiens
LTDPAQWEPV

SEQ ID NO: 2947 - protein, 10 aa, Homo sapiens
DPAQWEPVLV

SEQ ID NO: 2948 - protein, 10 aa, Homo sapiens
SVPLLTDPAQ

SEQ ID NO: 2949 - protein, 10 aa, Homo sapiens
LLTDPAQWEP

SEQ ID NO: 2950 - protein, 10 aa, Homo sapiens
QASVPLLTDP

SEQ ID NO: 2951 - protein, 10 aa, Homo sapiens
PLLTDPAQWE

SEQ ID NO: 2952 - protein, 10 aa, Homo sapiens
PQASVPLLTD

SEQ ID NO: 2953 - protein, 10 aa, Homo sapiens
QASVPLLTDL

SEQ ID NO: 2954 - protein, 10 aa, Homo sapiens
TDLAQWEPVL

SEQ ID NO: 2955 - protein, 10 aa, Homo sapiens
ASVPLLTDLA

SEQ ID NO: 2956 - protein, 10 aa, Homo sapiens
VPLLTDLAQW

SEQ ID NO: 2957 - protein, 10 aa, Homo sapiens
LTDLAQWEPV

SEQ ID NO: 2958 - protein, 10 aa, Homo sapiens
DLAQWEPVLV

SEQ ID NO: 2959 - protein, 10 aa, Homo sapiens
SVPLLTDLAQ

SEQ ID NO: 2960 - protein, 10 aa, Homo sapiens
LLTDLAQWEP

SEQ ID NO: 2961 - protein, 10 aa, Homo sapiens
PLLTDLAQWE

SEQ ID NO: 2962 - protein, 10 aa, Homo sapiens
QASVPLLTHL

SEQ ID NO: 2963 - protein, 10 aa, Homo sapiens
THLAQWEPVL

SEQ ID NO: 2964 - protein, 10 aa, Homo sapiens
ASVPLLTHLA

SEQ ID NO: 2965 - protein, 10 aa, Homo sapiens
VPLLTHLAQW

SEQ ID NO: 2966 - protein, 10 aa, Homo sapiens
LTHLAQWEPV

SEQ ID NO: 2967 - protein, 10 aa, Homo sapiens
HLAQWEPVLV

SEQ ID NO: 2968 - protein, 10 aa, Homo sapiens
LAQWEPVLVP

SEQ ID NO: 2969 - protein, 10 aa, Homo sapiens
SVPLLTHLAQ

SEQ ID NO: 2970 - protein, 10 aa, Homo sapiens
LLTHLAQWEP

SEQ ID NO: 2971 - protein, 10 aa, Homo sapiens
PLLTHLAQWE

SEQ ID NO: 2972 - protein, 10 aa, Homo sapiens
TPVPHPDPPM

SEQ ID NO: 2973 - protein, 10 aa, Homo sapiens
MYVCTPVPHP

SEQ ID NO: 2974 - protein, 10 aa, Homo sapiens
SLTMYVCTPV

SEQ ID NO: 2975 - protein, 10 aa, Homo sapiens
NASLTMYVCT

SEQ ID NO: 2976 - protein, 10 aa, Homo sapiens
CTPVPHPDPP

SEQ ID NO: 2977 - protein, 10 aa, Homo sapiens
LTMYVCTPVP

SEQ ID NO: 2978 - protein, 10 aa, Homo sapiens
ASLTMYVCTP

SEQ ID NO: 2979 - protein, 10 aa, Homo sapiens
YVCTPVPHPD

SEQ ID NO: 2980 - protein, 10 aa, Homo sapiens
VCTPVPHPDP

SEQ ID NO: 2981 - protein, 10 aa, Homo sapiens
TMYVCTPVPH

SEQ ID NO: 2982 - protein, 10 aa, Homo sapiens
RTPTRQISSI

SEQ ID NO: 2983 - protein, 10 aa, Homo sapiens
LSRTPTRQIS

SEQ ID NO: 2984 - protein, 10 aa, Homo sapiens
ISSIDTDPPA

SEQ ID NO: 2985 - protein, 10 aa, Homo sapiens
RQISSIDTDP

SEQ ID NO: 2986 - protein, 10 aa, Homo sapiens
SSIDTDPPAD

SEQ ID NO: 2987 - protein, 10 aa, Homo sapiens
TPTRQISSID

SEQ ID NO: 2988 - protein, 10 aa, Homo sapiens
SRTPTRQISS

SEQ ID NO: 2989 - protein, 10 aa, Homo sapiens
QISSIDTDPP

SEQ ID NO: 2990 - protein, 10 aa, Homo sapiens
PTRQISSIDT

SEQ ID NO: 2991 - protein, 10 aa, Homo sapiens
TRQISSIDTD

SEQ ID NO: 2992 - protein, 10 aa, Homo sapiens
RTPTRQISSS

SEQ ID NO: 2993 - protein, 10 aa, Homo sapiens
ISSSDTDPPA

SEQ ID NO: 2994 - protein, 10 aa, Homo sapiens
RQISSSDTDP

SEQ ID NO: 2995 - protein, 10 aa, Homo sapiens
TPTRQISSSD

SEQ ID NO: 2996 - protein, 10 aa, Homo sapiens
SSSDTDPPAD

SEQ ID NO: 2997 - protein, 10 aa, Homo sapiens
QISSSDTDPP

SEQ ID NO: 2998 - protein, 10 aa, Homo sapiens
PTRQISSSDT

SEQ ID NO: 2999 - protein, 10 aa, Homo sapiens
TRQISSSDTD

SEQ ID NO: 3000 - protein, 10 aa, Homo sapiens
PSRGQALRRA

SEQ ID NO: 3001 - protein, 10 aa, Homo sapiens
SRGQALRRAQ

SEQ ID NO: 3002 - protein, 9 aa, Homo sapiens
TARIRAVGL

SEQ ID NO: 3003 - protein, 9 aa, Homo sapiens
QPAAAILAL

SEQ ID NO: 3004 - protein, 9 aa, Homo sapiens
TVISKGCSL

SEQ ID NO: 3005 - protein, 9 aa, Homo sapiens
LALQPGTAL

SEQ ID NO: 3006 - protein, 9 aa, Homo sapiens
LALLPALGL

SEQ ID NO: 3007 - protein, 9 aa, Homo sapiens
AQVSNEDCL

SEQ ID NO: 3008 - protein, 9 aa, Homo sapiens
AILALLPAL

SEQ ID NO: 3009 - protein, 9 aa, Homo sapiens
ALLPALGLL

SEQ ID NO: 3010 - protein, 9 aa, Homo sapiens
ALQPAAAIL

SEQ ID NO: 3011 - protein, 9 aa, Homo sapiens
ALLMAGLAL

SEQ ID NO: 3012 - protein, 9 aa, Homo sapiens
ALQPGTALL

SEQ ID NO: 3013 - protein, 9 aa, Homo sapiens
CNASGAHAL

SEQ ID NO: 3014 - protein, 9 aa, Homo sapiens
LQVENCTQL

SEQ ID NO: 3015 - protein, 9 aa, Homo sapiens
NITCCDTDL

SEQ ID NO: 3016 - protein, 9 aa, Homo sapiens
LLPALGLLL

SEQ ID NO: 3017 - protein, 9 aa, Homo sapiens
LLALLMAGL

SEQ ID NO: 3018 - protein, 9 aa, Homo sapiens
LLLWGPGQL

SEQ ID NO: 3019 - protein, 9 aa, Homo sapiens
KAVLLALLM

SEQ ID NO: 3020 - protein, 9 aa, Homo sapiens
HALQPAAAI

SEQ ID NO: 3021 - protein, 9 aa, Homo sapiens
AVLLALLMA

SEQ ID NO: 3022 - protein, 9 aa, Homo sapiens
PAAAILALL

SEQ ID NO: 3023 - protein, 9 aa, Homo sapiens
RAVGLLTVI

SEQ ID NO: 3024 - protein, 9 aa, Homo sapiens
ARIRAVGLL

SEQ ID NO: 3025 - protein, 9 aa, Homo sapiens
RIRAVGLLT

SEQ ID NO: 3026 - protein, 9 aa, Homo sapiens
AAILALLPA

SEQ ID NO: 3027 - protein, 9 aa, Homo sapiens
YVGKKNITC

SEQ ID NO: 3028 - protein, 9 aa, Homo sapiens
QPGTALLCY

SEQ ID NO: 3029 - protein, 9 aa, Homo sapiens
LPALGLLLW

SEQ ID NO: 3030 - protein, 9 aa, Homo sapiens
MKAVLLALL

SEQ ID NO: 3031 - protein, 9 aa, Homo sapiens
AVGLLTVIS

SEQ ID NO: 3032 - protein, 9 aa, Homo sapiens
GAHALQPAA

SEQ ID NO: 3033 - protein, 9 aa, Homo sapiens
AGLALQPGT

SEQ ID NO: 3034 - protein, 9 aa, Homo sapiens
ALLCYSCKA

SEQ ID NO: 3035 - protein, 9 aa, Homo sapiens
LALLMAGLA

SEQ ID NO: 3036 - protein, 9 aa, Homo sapiens
KAQVSNEDC

SEQ ID NO: 3037 - protein, 9 aa, Homo sapiens
LCYSCKAQV

SEQ ID NO: 3038 - protein, 9 aa, Homo sapiens
VSNEDCLQV

SEQ ID NO: 3039 - protein, 9 aa, Homo sapiens
QCWTARIRA

SEQ ID NO: 3040 - protein, 9 aa, Homo sapiens
DCLQVENCT

SEQ ID NO: 3041 - protein, 9 aa, Homo sapiens
GTALLCYSC

SEQ ID NO: 3042 - protein, 9 aa, Homo sapiens
LQPGTALLC

SEQ ID NO: 3043 - protein, 9 aa, Homo sapiens
ISKGCSLNC

SEQ ID NO: 3044 - protein, 9 aa, Homo sapiens
SGAHALQPA

SEQ ID NO: 3045 - protein, 9 aa, Homo sapiens
VGKKNITCC

SEQ ID NO: 3046 - protein, 9 aa, Homo sapiens
NCTQLGEQC

SEQ ID NO: 3047 - protein, 9 aa, Homo sapiens
QLGEQCWTA

SEQ ID NO: 3048 - protein, 9 aa, Homo sapiens
LQPAAAILA

SEQ ID NO: 3049 - protein, 9 aa, Homo sapiens
ITCCDTDLC

SEQ ID NO: 3050 - protein, 9 aa, Homo sapiens
LCNASGAHA

SEQ ID NO: 3051 - protein, 9 aa, Homo sapiens
TQLGEQCWT

SEQ ID NO: 3052 - protein, 9 aa, Homo sapiens
GLALQPGTA

SEQ ID NO: 3053 - protein, 9 aa, Homo sapiens
LLTVISKGC

SEQ ID NO: 3054 - protein, 9 aa, Homo sapiens
AAAILALLP

SEQ ID NO: 3055 - protein, 9 aa, Homo sapiens
QVSNEDCLQ

SEQ ID NO: 3056 - protein, 9 aa, Homo sapiens
GEQCWTARI

SEQ ID NO: 3057 - protein, 9 aa, Homo sapiens
DYYVGKKNI

SEQ ID NO: 3058 - protein, 9 aa, Homo sapiens
ASGAHALQP

SEQ ID NO: 3059 - protein, 9 aa, Homo sapiens
ALGLLLWGP

SEQ ID NO: 3060 - protein, 9 aa, Homo sapiens
AHALQPAAA

SEQ ID NO: 3061 - protein, 9 aa, Homo sapiens
CVDDSQDYY

SEQ ID NO: 3062 - protein, 9 aa, Homo sapiens
LLMAGLALQ

SEQ ID NO: 3063 - protein, 9 aa, Homo sapiens
MAGLALQPG

SEQ ID NO: 3064 - protein, 9 aa, Homo sapiens
NASGAHALQ

SEQ ID NO: 3065 - protein, 9 aa, Homo sapiens
TALLCYSCK

SEQ ID NO: 3066 - protein, 9 aa, Homo sapiens
CCDTDLCNA

SEQ ID NO: 3067 - protein, 9 aa, Homo sapiens
NCVDDSQDY

SEQ ID NO: 3068 - protein, 9 aa, Homo sapiens
SKGCSLNCV

SEQ ID NO: 3069 - protein, 9 aa, Homo sapiens
CTQLGEQCW

SEQ ID NO: 3070 - protein, 9 aa, Homo sapiens
LTVISKGCS

SEQ ID NO: 3071 - protein, 9 aa, Homo sapiens
TCCDTDLCN

SEQ ID NO: 3072 - protein, 9 aa, Homo sapiens
VISKGCSLN

SEQ ID NO: 3073 - protein, 9 aa, Homo sapiens
CSLNCVDDS

SEQ ID NO: 3074 - protein, 9 aa, Homo sapiens
IRAVGLLTV

SEQ ID NO: 3075 - protein, 9 aa, Homo sapiens
CWTARIRAV

SEQ ID NO: 3076 - protein, 9 aa, Homo sapiens
YSCKAQVSN

SEQ ID NO: 3077 - protein, 9 aa, Homo sapiens
QVENCTQLG

SEQ ID NO: 3078 - protein, 9 aa, Homo sapiens
WTARIRAVG

SEQ ID NO: 3079 - protein, 9 aa, Homo sapiens
EDCLQVENC

SEQ ID NO: 3080 - protein, 9 aa, Homo sapiens
EQCWTARIR

SEQ ID NO: 3081 - protein, 9 aa, Homo sapiens
KGCSLNCVD

SEQ ID NO: 3082 - protein, 9 aa, Homo sapiens
GCSLNCVDD

SEQ ID NO: 3083 - protein, 9 aa, Homo sapiens
LGLLLWGPG

SEQ ID NO: 3084 - protein, 9 aa, Homo sapiens
GLLTVISKG

SEQ ID NO: 3085 - protein, 9 aa, Homo sapiens
CLQVENCTQ

SEQ ID NO: 3086 - protein, 9 aa, Homo sapiens
LLCYSCKAQ

SEQ ID NO: 3087 - protein, 9 aa, Homo sapiens
SLNCVDDSQ

SEQ ID NO: 3088 - protein, 9 aa, Homo sapiens
DLCNASGAH

SEQ ID NO: 3089 - protein, 9 aa, Homo sapiens
KKNITCCDT

SEQ ID NO: 3090 - protein, 9 aa, Homo sapiens
ENCTQLGEQ

SEQ ID NO: 3091 - protein, 9 aa, Homo sapiens
GLLLWGPGQ

SEQ ID NO: 3092 - protein, 9 aa, Homo sapiens
DSQDYYVGK

SEQ ID NO: 3093 - protein, 9 aa, Homo sapiens
LMAGLALQP

SEQ ID NO: 3094 - protein, 9 aa, Homo sapiens
SCKAQVSNE

SEQ ID NO: 3095 - protein, 9 aa, Homo sapiens
LNCVDDSQD

SEQ ID NO: 3096 - protein, 9 aa, Homo sapiens
ILALLPALG

SEQ ID NO: 3097 - protein, 9 aa, Homo sapiens
TDLCNASGA

SEQ ID NO: 3098 - protein, 9 aa, Homo sapiens
YYVGKKNIT

SEQ ID NO: 3099 - protein, 9 aa, Homo sapiens
VLLALLMAG

SEQ ID NO: 3100 - protein, 9 aa, Homo sapiens
VGLLTVISK

SEQ ID NO: 3101 - protein, 9 aa, Homo sapiens
KNITCCDTD

SEQ ID NO: 3102 - protein, 9 aa, Homo sapiens
LPPSLRCSL

SEQ ID NO: 3103 - protein, 9 aa, Homo sapiens
FPAHPIYDL

SEQ ID NO: 3104 - protein, 9 aa, Homo sapiens
VPQASVPLL

SEQ ID NO: 3105 - protein, 9 aa, Homo sapiens
HPAQWEPVL

SEQ ID NO: 3106 - protein, 9 aa, Homo sapiens
VVPQASVPL

SEQ ID NO: 3107 - protein, 9 aa, Homo sapiens
APLQPTLGV

SEQ ID NO: 3108 - protein, 9 aa, Homo sapiens
AGPMPCSRL

SEQ ID NO: 3109 - protein, 9 aa, Homo sapiens
TPTRQIGSI

SEQ ID NO: 3110 - protein, 9 aa, Homo sapiens
LSRTPTRQI

SEQ ID NO: 3111 - protein, 9 aa, Homo sapiens
WARRTSRAV

SEQ ID NO: 3112 - protein, 9 aa, Homo sapiens
HPIYDLSQV

SEQ ID NO: 3113 - protein, 9 aa, Homo sapiens
TLNPVLRHL

SEQ ID NO: 3114 - protein, 9 aa, Homo sapiens
SYRLWGAPL

SEQ ID NO: 3115 - protein, 9 aa, Homo sapiens
WGAPLQPTL

SEQ ID NO: 3116 - protein, 9 aa, Homo sapiens
GPSNPLCCC

SEQ ID NO: 3117 - protein, 9 aa, Homo sapiens
SPAPSRGQA

SEQ ID NO: 3118 - protein, 9 aa, Homo sapiens
VPHPDPPMA

SEQ ID NO: 3119 - protein, 9 aa, Homo sapiens
DPPMALSRT

SEQ ID NO: 3120 - protein, 9 aa, Homo sapiens
TCATPAGPM

SEQ ID NO: 3121 - protein, 9 aa, Homo sapiens
PAPSRGQAL

SEQ ID NO: 3122 - protein, 9 aa, Homo sapiens
SGDPASYRL

SEQ ID NO: 3123 - protein, 9 aa, Homo sapiens
AFSTLNPVL

SEQ ID NO: 3124 - protein, 9 aa, Homo sapiens
TSRAVTPTC

SEQ ID NO: 3125 - protein, 9 aa, Homo sapiens
SLRCSLHSA

SEQ ID NO: 3126 - protein, 9 aa, Homo sapiens
PVPHPDPPM

SEQ ID NO: 3127 - protein, 9 aa, Homo sapiens
GPMPCSRLP

SEQ ID NO: 3128 - protein, 9 aa, Homo sapiens
TPAGPMPCS

SEQ ID NO: 3129 - protein, 9 aa, Homo sapiens
LTMYVCAPV

SEQ ID NO: 3130 - protein, 9 aa, Homo sapiens
APSRGQALR

SEQ ID NO: 3131 - protein, 9 aa, Homo sapiens
APVPHPDPP

SEQ ID NO: 3132 - protein, 9 aa, Homo sapiens
PADGPSNPL

SEQ ID NO: 3133 - protein, 9 aa, Homo sapiens
LVPEAHPNA

SEQ ID NO: 3134 - protein, 9 aa, Homo sapiens
QVWSVVSPA

SEQ ID NO: 3135 - protein, 9 aa, Homo sapiens
SVPLLTHPA

SEQ ID NO: 3136 - protein, 9 aa, Homo sapiens
ARRTSRAVT

SEQ ID NO: 3137 - protein, 9 aa, Homo sapiens
RAVTPTCAT

SEQ ID NO: 3138 - protein, 9 aa, Homo sapiens
PCSRLPPSL

SEQ ID NO: 3139 - protein, 9 aa, Homo sapiens
HPNASLTMY

SEQ ID NO: 3140 - protein, 9 aa, Homo sapiens
DPPADGPSN

SEQ ID NO: 3141 - protein, 9 aa, Homo sapiens
MPCSRLPPS

SEQ ID NO: 3142 - protein, 9 aa, Homo sapiens
FHGPAFSTL

SEQ ID NO: 3143 - protein, 9 aa, Homo sapiens
AHPNASLTM

SEQ ID NO: 3144 - protein, 9 aa, Homo sapiens
SACCSGDPA

SEQ ID NO: 3145 - protein, 9 aa, Homo sapiens
DPASYRLWG

SEQ ID NO: 3146 - protein, 9 aa, Homo sapiens
ATPAGPMPC

SEQ ID NO: 3147 - protein, 9 aa, Homo sapiens
LGVVPQASV

SEQ ID NO: 3148 - protein, 9 aa, Homo sapiens
ASLTMYVCA

SEQ ID NO: 3149 - protein, 9 aa, Homo sapiens
EAHPNASLT

SEQ ID NO: 3150 - protein, 9 aa, Homo sapiens
NASLTMYVC

SEQ ID NO: 3151 - protein, 9 aa, Homo sapiens
NPVLRHLFP

SEQ ID NO: 3152 - protein, 9 aa, Homo sapiens
DLSQVWSVV

SEQ ID NO: 3153 - protein, 9 aa, Homo sapiens
EPVLVPEAH

SEQ ID NO: 3154 - protein, 9 aa, Homo sapiens
QPTLGVVPQ

SEQ ID NO: 3155 - protein, 9 aa, Homo sapiens
NPLCCCFHG

SEQ ID NO: 3156 - protein, 9 aa, Homo sapiens
FPQEAFPAH

SEQ ID NO: 3157 - protein, 9 aa, Homo sapiens
TPTCATPAG

SEQ ID NO: 3158 - protein, 9 aa, Homo sapiens
VPLLTHPAQ

SEQ ID NO: 3159 - protein, 9 aa, Homo sapiens
GPAFSTLNP

SEQ ID NO: 3160 - protein, 9 aa, Homo sapiens
HPDPPMALS

SEQ ID NO: 3161 - protein, 9 aa, Homo sapiens
CSRLPPSLR

SEQ ID NO: 3162 - protein, 9 aa, Homo sapiens
AVTPTCATP

SEQ ID NO: 3163 - protein, 9 aa, Homo sapiens
VPEAHPNAS

SEQ ID NO: 3164 - protein, 9 aa, Homo sapiens
RTSRAVTPT

SEQ ID NO: 3165 - protein, 9 aa, Homo sapiens
DGPSNPLCC

SEQ ID NO: 3166 - protein, 9 aa, Homo sapiens
VTPTCATPA

SEQ ID NO: 3167 - protein, 9 aa, Homo sapiens
GSIDTDPPA

SEQ ID NO: 3168 - protein, 9 aa, Homo sapiens
RTTTWARRT

SEQ ID NO: 3169 - protein, 9 aa, Homo sapiens
VLRHLFPQE

SEQ ID NO: 3170 - protein, 9 aa, Homo sapiens
RCSLHSACC

SEQ ID NO: 3171 - protein, 9 aa, Homo sapiens
LCCCFHGPA

SEQ ID NO: 3172 - protein, 9 aa, Homo sapiens
MTHRTTTWA

SEQ ID NO: 3173 - protein, 9 aa, Homo sapiens
SVVSPAPSR

SEQ ID NO: 3174 - protein, 9 aa, Homo sapiens
YVCAPVPHP

SEQ ID NO: 3175 - protein, 9 aa, Homo sapiens
ACCSGDPAS

SEQ ID NO: 3176 - protein, 9 aa, Homo sapiens
EAFPAHPIY

SEQ ID NO: 3177 - protein, 9 aa, Homo sapiens
PEAHPNASL

SEQ ID NO: 3178 - protein, 9 aa, Homo sapiens
PPMALSRTP

SEQ ID NO: 3179 - protein, 9 aa, Homo sapiens
PHPDPPMAL

SEQ ID NO: 3180 - protein, 9 aa, Homo sapiens
PAQWEPVLV

SEQ ID NO: 3181 - protein, 9 aa, Homo sapiens
PAFSTLNPV

SEQ ID NO: 3182 - protein, 9 aa, Homo sapiens
QEAFPAHPI

SEQ ID NO: 3183 - protein, 9 aa, Homo sapiens
VVSPAPSRG

SEQ ID NO: 3184 - protein, 9 aa, Homo sapiens
GVVPQASVP

SEQ ID NO: 3185 - protein, 9 aa, Homo sapiens
CAPVPHPDP

SEQ ID NO: 3186 - protein, 9 aa, Homo sapiens
AQWEPVLVP

SEQ ID NO: 3187 - protein, 9 aa, Homo sapiens
QASVPLLTH

SEQ ID NO: 3188 - protein, 9 aa, Homo sapiens
ASYRLWGAP

SEQ ID NO: 3189 - protein, 9 aa, Homo sapiens
ADGPSNPLC

SEQ ID NO: 3190 - protein, 9 aa, Homo sapiens
GAPLQPTLG

SEQ ID NO: 3191 - protein, 9 aa, Homo sapiens
MALSRTPTR

SEQ ID NO: 3192 - protein, 9 aa, Homo sapiens
PASYRLWGA

SEQ ID NO: 3193 - protein, 9 aa, Homo sapiens
ASVPLLTHP

SEQ ID NO: 3194 - protein, 9 aa, Homo sapiens
TTTWARRTS

SEQ ID NO: 3195 - protein, 9 aa, Homo sapiens
CATPAGPMP

SEQ ID NO: 3196 - protein, 9 aa, Homo sapiens
ALSRTPTRQ

SEQ ID NO: 3197 - protein, 9 aa, Homo sapiens
LNPVLRHLF

SEQ ID NO: 3198 - protein, 9 aa, Homo sapiens
CCFHGPAFS

SEQ ID NO: 3199 - protein, 9 aa, Homo sapiens
PLQPTLGVV

SEQ ID NO: 3200 - protein, 9 aa, Homo sapiens
PPADGPSNP

SEQ ID NO: 3201 - protein, 9 aa, Homo sapiens
RLPPSLRCS

SEQ ID NO: 3202 - protein, 9 aa, Homo sapiens
GPMPCSRLL

SEQ ID NO: 3203 - protein, 9 aa, Homo sapiens
LLPSLRCSL

SEQ ID NO: 3204 - protein, 9 aa, Homo sapiens
MPCSRLLPS

SEQ ID NO: 3205 - protein, 9 aa, Homo sapiens
PCSRLLPSL

SEQ ID NO: 3206 - protein, 9 aa, Homo sapiens
LPSLRCSLH

SEQ ID NO: 3207 - protein, 9 aa, Homo sapiens
CSRLLPSLR

SEQ ID NO: 3208 - protein, 9 aa, Homo sapiens
RLLPSLRCS

SEQ ID NO: 3209 - protein, 9 aa, Homo sapiens
SRLLPSLRC

SEQ ID NO: 3210 - protein, 9 aa, Homo sapiens
PMPCSRLLP

SEQ ID NO: 3211 - protein, 9 aa, Homo sapiens
SSRLWGAPL

SEQ ID NO: 3212 - protein, 9 aa, Homo sapiens
SGDPASSRL

SEQ ID NO: 3213 - protein, 9 aa, Homo sapiens
DPASSRLWG

SEQ ID NO: 3214 - protein, 9 aa, Homo sapiens
PASSRLWGA

SEQ ID NO: 3215 - protein, 9 aa, Homo sapiens
ASSRLWGAP

SEQ ID NO: 3216 - protein, 9 aa, Homo sapiens
CCSGDPASS

SEQ ID NO: 3217 - protein, 9 aa, Homo sapiens
CSGDPASSR

SEQ ID NO: 3218 - protein, 9 aa, Homo sapiens
GDPASSRLW

SEQ ID NO: 3219 - protein, 9 aa, Homo sapiens
SRLWGAPLQ

SEQ ID NO: 3220 - protein, 9 aa, Homo sapiens
DPAQWEPVL

SEQ ID NO: 3221 - protein, 9 aa, Homo sapiens
SVPLLTDPA

SEQ ID NO: 3222 - protein, 9 aa, Homo sapiens
VPLLTDPAQ

SEQ ID NO: 3223 - protein, 9 aa, Homo sapiens
QASVPLLTD

SEQ ID NO: 3224 - protein, 9 aa, Homo sapiens
ASVPLLTDP

SEQ ID NO: 3225 - protein, 9 aa, Homo sapiens
TDPAQWEPV

SEQ ID NO: 3226 - protein, 9 aa, Homo sapiens
LLTDPAQWE

SEQ ID NO: 3227 - protein, 9 aa, Homo sapiens
LTDPAQWEP

SEQ ID NO: 3228 - protein, 9 aa, Homo sapiens
PLLTDPAQW

SEQ ID NO: 3229 - protein, 9 aa, Homo sapiens
ASVPLLTDL

SEQ ID NO: 3230 - protein, 9 aa, Homo sapiens
DLAQWEPVL

SEQ ID NO: 3231 - protein, 9 aa, Homo sapiens
SVPLLTDLA

SEQ ID NO: 3232 - protein, 9 aa, Homo sapiens
VPLLTDLAQ

SEQ ID NO: 3233 - protein, 9 aa, Homo sapiens
TDLAQWEPV

SEQ ID NO: 3234 - protein, 9 aa, Homo sapiens
LLTDLAQWE

SEQ ID NO: 3235 - protein, 9 aa, Homo sapiens
LTDLAQWEP

SEQ ID NO: 3236 - protein, 9 aa, Homo sapiens
PLLTDLAQW

SEQ ID NO: 3237 - protein, 9 aa, Homo sapiens
ASVPLLTHL

SEQ ID NO: 3238 - protein, 9 aa, Homo sapiens
HLAQWEPVL

SEQ ID NO: 3239 - protein, 9 aa, Homo sapiens
LAQWEPVLV

SEQ ID NO: 3240 - protein, 9 aa, Homo sapiens
SVPLLTHLA

SEQ ID NO: 3241 - protein, 9 aa, Homo sapiens
VPLLTHLAQ

SEQ ID NO: 3242 - protein, 9 aa, Homo sapiens
THLAQWEPV

SEQ ID NO: 3243 - protein, 9 aa, Homo sapiens
LTHLAQWEP

SEQ ID NO: 3244 - protein, 9 aa, Homo sapiens
LLTHLAQWE

SEQ ID NO: 3245 - protein, 9 aa, Homo sapiens
PLLTHLAQW

SEQ ID NO: 3246 - protein, 9 aa, Homo sapiens
LTMYVCTPV

SEQ ID NO: 3247 - protein, 9 aa, Homo sapiens
ASLTMYVCT

SEQ ID NO: 3248 - protein, 9 aa, Homo sapiens
YVCTPVPHP

SEQ ID NO: 3249 - protein, 9 aa, Homo sapiens
CTPVPHPDP

SEQ ID NO: 3250 - protein, 9 aa, Homo sapiens
TMYVCTPVP

SEQ ID NO: 3251 - protein, 9 aa, Homo sapiens
VCTPVPHPD

SEQ ID NO: 3252 - protein, 9 aa, Homo sapiens
SLTMYVCTP

SEQ ID NO: 3253 - protein, 9 aa, Homo sapiens
MYVCTPVPH

SEQ ID NO: 3254 - protein, 9 aa, Homo sapiens
TPTRQISSI

SEQ ID NO: 3255 - protein, 9 aa, Homo sapiens
SSIDTDPPA

SEQ ID NO: 3256 - protein, 9 aa, Homo sapiens
RTPTRQISS

SEQ ID NO: 3257 - protein, 9 aa, Homo sapiens
ISSIDTDPP

SEQ ID NO: 3258 - protein, 9 aa, Homo sapiens
QISSIDTDP

SEQ ID NO: 3259 - protein, 9 aa, Homo sapiens
PTRQISSID

SEQ ID NO: 3260 - protein, 9 aa, Homo sapiens
RQISSIDTD

SEQ ID NO: 3261 - protein, 9 aa, Homo sapiens
TRQISSIDT

SEQ ID NO: 3262 - protein, 9 aa, Homo sapiens
SRTPTRQIS

SEQ ID NO: 3263 - protein, 9 aa, Homo sapiens
TPTRQISSS

SEQ ID NO: 3264 - protein, 9 aa, Homo sapiens
SSSDTDPPA

SEQ ID NO: 3265 - protein, 9 aa, Homo sapiens
QISSSDTDP

SEQ ID NO: 3266 - protein, 9 aa, Homo sapiens
ISSSDTDPP

SEQ ID NO: 3267 - protein, 9 aa, Homo sapiens
TRQISSSDT

SEQ ID NO: 3268 - protein, 9 aa, Homo sapiens
PTRQISSSD

SEQ ID NO: 3269 - protein, 9 aa, Homo sapiens
RQISSSDTD

SEQ ID NO: 3270 - protein, 9 aa, Homo sapiens
TPTRQIGSS

SEQ ID NO: 3271 - protein, 9 aa, Homo sapiens
GSSDTDPPA

SEQ ID NO: 3272 - protein, 9 aa, Homo sapiens
QIGSSDTDP

SEQ ID NO: 3273 - protein, 9 aa, Homo sapiens
IGSSDTDPP

SEQ ID NO: 3274 - protein, 9 aa, Homo sapiens
RQIGSSDTD

SEQ ID NO: 3275 - protein, 9 aa, Homo sapiens
TRQIGSSDT

SEQ ID NO: 3276 - protein, 9 aa, Homo sapiens
PTRQIGSSD

SEQ ID NO: 3277 - protein, 9 aa, Homo sapiens
SSDTDPPAD

SEQ ID NO: 3278 - protein, 9 aa, Homo sapiens
SDTDPPADG

SEQ ID NO: 3279 - protein, 9 aa, Homo sapiens
RGQALRRAQ

SEQ ID NO: 3280 - protein, 9 aa, Homo sapiens
SRGQALRRA

SEQ ID NO: 3281 - protein, 10 aa, Homo sapiens
TARIRAVGLL

SEQ ID NO: 3282 - protein, 10 aa, Homo sapiens
QPAAAILALL

SEQ ID NO: 3283 - protein, 10 aa, Homo sapiens
AAILALLPAL

SEQ ID NO: 3284 - protein, 10 aa, Homo sapiens
ALLPALGLLL

SEQ ID NO: 3285 - protein, 10 aa, Homo sapiens
LALLPALGLL

SEQ ID NO: 3286 - protein, 10 aa, Homo sapiens
HALQPAAAIL

SEQ ID NO: 3287 - protein, 10 aa, Homo sapiens
LALLMAGLAL

SEQ ID NO: 3288 - protein, 10 aa, Homo sapiens
KAQVSNEDCL

SEQ ID NO: 3289 - protein, 10 aa, Homo sapiens
LALQPGTALL

SEQ ID NO: 3290 - protein, 10 aa, Homo sapiens
ILALLPALGL

SEQ ID NO: 3291 - protein, 10 aa, Homo sapiens
GLALQPGTAL

SEQ ID NO: 3292 - protein, 10 aa, Homo sapiens
CLQVENCTQL

SEQ ID NO: 3293 - protein, 10 aa, Homo sapiens
LTVISKGCSL

SEQ ID NO: 3294 - protein, 10 aa, Homo sapiens
LCNASGAHAL

SEQ ID NO: 3295 - protein, 10 aa, Homo sapiens
GLLLWGPGQL

SEQ ID NO: 3296 - protein, 10 aa, Homo sapiens
LQPAAAILAL

SEQ ID NO: 3297 - protein, 10 aa, Homo sapiens
WTARIRAVGL

SEQ ID NO: 3298 - protein, 10 aa, Homo sapiens
VLLALLMAGL

SEQ ID NO: 3299 - protein, 10 aa, Homo sapiens
KNITCCDTDL

SEQ ID NO: 3300 - protein, 10 aa, Homo sapiens
RIRAVGLLTV

SEQ ID NO: 3301 - protein, 10 aa, Homo sapiens
QVSNEDCLQV

SEQ ID NO: 3302 - protein, 10 aa, Homo sapiens
AAAILALLPA

SEQ ID NO: 3303 - protein, 10 aa, Homo sapiens
YVGKKNITCC

SEQ ID NO: 3304 - protein, 10 aa, Homo sapiens
QPGTALLCYS

SEQ ID NO: 3305 - protein, 10 aa, Homo sapiens
CVDDSQDYYV

SEQ ID NO: 3306 - protein, 10 aa, Homo sapiens
AGLALQPGTA

SEQ ID NO: 3307 - protein, 10 aa, Homo sapiens
ALQPAAAILA

SEQ ID NO: 3308 - protein, 10 aa, Homo sapiens
MAGLALQPGT

SEQ ID NO: 3309 - protein, 10 aa, Homo sapiens
GAHALQPAAA

SEQ ID NO: 3310 - protein, 10 aa, Homo sapiens
ASGAHALQPA

SEQ ID NO: 3311 - protein, 10 aa, Homo sapiens
KAVLLALLMA

SEQ ID NO: 3312 - protein, 10 aa, Homo sapiens
TALLCYSCKA

SEQ ID NO: 3313 - protein, 10 aa, Homo sapiens
ALQPGTALLC

SEQ ID NO: 3314 - protein, 10 aa, Homo sapiens
ISKGCSLNCV

SEQ ID NO: 3315 - protein, 10 aa, Homo sapiens
LPALGLLLWG

SEQ ID NO: 3316 - protein, 10 aa, Homo sapiens
LLCYSCKAQV

SEQ ID NO: 3317 - protein, 10 aa, Homo sapiens
QCWTARIRAV

SEQ ID NO: 3318 - protein, 10 aa, Homo sapiens
AHALQPAAAI

SEQ ID NO: 3319 - protein, 10 aa, Homo sapiens
AVLLALLMAG

SEQ ID NO: 3320 - protein, 10 aa, Homo sapiens
EQCWTARIRA

SEQ ID NO: 3321 - protein, 10 aa, Homo sapiens
AVGLLTVISK

SEQ ID NO: 3322 - protein, 10 aa, Homo sapiens
LGEQCWTARI

SEQ ID NO: 3323 - protein, 10 aa, Homo sapiens
CTQLGEQCWT

SEQ ID NO: 3324 - protein, 10 aa, Homo sapiens
TVISKGCSLN

SEQ ID NO: 3325 - protein, 10 aa, Homo sapiens
GLLTVISKGC

SEQ ID NO: 3326 - protein, 10 aa, Homo sapiens
VISKGCSLNC

SEQ ID NO: 3327 - protein, 10 aa, Homo sapiens
LLALLMAGLA

SEQ ID NO: 3328 - protein, 10 aa, Homo sapiens
DLCNASGAHA

SEQ ID NO: 3329 - protein, 10 aa, Homo sapiens
TQLGEQCWTA

SEQ ID NO: 3330 - protein, 10 aa, Homo sapiens
ENCTQLGEQC

SEQ ID NO: 3331 - protein, 10 aa, Homo sapiens
MKAVLLALLM

SEQ ID NO: 3332 - protein, 10 aa, Homo sapiens
SGAHALQPAA

SEQ ID NO: 3333 - protein, 10 aa, Homo sapiens
NITCCDTDLC

SEQ ID NO: 3334 - protein, 10 aa, Homo sapiens
TCCDTDLCNA

SEQ ID NO: 3335 - protein, 10 aa, Homo sapiens
RAVGLLTVIS

SEQ ID NO: 3336 - protein, 10 aa, Homo sapiens
QDYYVGKKNI

SEQ ID NO: 3337 - protein, 10 aa, Homo sapiens
IRAVGLLTVI

SEQ ID NO: 3338 - protein, 10 aa, Homo sapiens
ARIRAVGLLT

SEQ ID NO: 3339 - protein, 10 aa, Homo sapiens
AILALLPALG

SEQ ID NO: 3340 - protein, 10 aa, Homo sapiens
ALGLLLWGPG

SEQ ID NO: 3341 - protein, 10 aa, Homo sapiens
LLMAGLALQP

SEQ ID NO: 3342 - protein, 10 aa, Homo sapiens
AQVSNEDCLQ

SEQ ID NO: 3343 - protein, 10 aa, Homo sapiens
NASGAHALQP

SEQ ID NO: 3344 - protein, 10 aa, Homo sapiens
ALLCYSCKAQ

SEQ ID NO: 3345 - protein, 10 aa, Homo sapiens
ALLMAGLALQ

SEQ ID NO: 3346 - protein, 10 aa, Homo sapiens
DTDLCNASGA

SEQ ID NO: 3347 - protein, 10 aa, Homo sapiens
NCVDDSQDYY

SEQ ID NO: 3348 - protein, 10 aa, Homo sapiens
LLTVISKGCS

SEQ ID NO: 3349 - protein, 10 aa, Homo sapiens
GCSLNCVDDS

SEQ ID NO: 3350 - protein, 10 aa, Homo sapiens
LNCVDDSQDY

SEQ ID NO: 3351 - protein, 10 aa, Homo sapiens
NCTQLGEQCW

SEQ ID NO: 3352 - protein, 10 aa, Homo sapiens
LLPALGLLLW

SEQ ID NO: 3353 - protein, 10 aa, Homo sapiens
ITCCDTDLCN

SEQ ID NO: 3354 - protein, 10 aa, Homo sapiens
LCYSCKAQVS

SEQ ID NO: 3355 - protein, 10 aa, Homo sapiens
LQPGTALLCY

SEQ ID NO: 3356 - protein, 10 aa, Homo sapiens
QVENCTQLGE

SEQ ID NO: 3357 - protein, 10 aa, Homo sapiens
DCLQVENCTQ

SEQ ID NO: 3358 - protein, 10 aa, Homo sapiens
EDCLQVENCT

SEQ ID NO: 3359 - protein, 10 aa, Homo sapiens
SCKAQVSNED

SEQ ID NO: 3360 - protein, 10 aa, Homo sapiens
VGKKNITCCD

SEQ ID NO: 3361 - protein, 10 aa, Homo sapiens
KGCSLNCVDD

SEQ ID NO: 3362 - protein, 10 aa, Homo sapiens
DSQDYYVGKK

SEQ ID NO: 3363 - protein, 10 aa, Homo sapiens
CKAQVSNEDC

SEQ ID NO: 3364 - protein, 10 aa, Homo sapiens
CNASGAHALQ

SEQ ID NO: 3365 - protein, 10 aa, Homo sapiens
SLNCVDDSQD

SEQ ID NO: 3366 - protein, 10 aa, Homo sapiens
GKKNITCCDT

SEQ ID NO: 3367 - protein, 10 aa, Homo sapiens
CSLNCVDDSQ

SEQ ID NO: 3368 - protein, 10 aa, Homo sapiens
DYYVGKKNIT

SEQ ID NO: 3369 - protein, 10 aa, Homo sapiens
YYVGKKNITC

SEQ ID NO: 3370 - protein, 10 aa, Homo sapiens
VSNEDCLQVE

SEQ ID NO: 3371 - protein, 10 aa, Homo sapiens
YSCKAQVSNE

SEQ ID NO: 3372 - protein, 10 aa, Homo sapiens
PGTALLCYSC

SEQ ID NO: 3373 - protein, 10 aa, Homo sapiens
LMAGLALQPG

SEQ ID NO: 3374 - protein, 10 aa, Homo sapiens
VGLLTVISKG

SEQ ID NO: 3375 - protein, 10 aa, Homo sapiens
LQVENCTQLG

SEQ ID NO: 3376 - protein, 10 aa, Homo sapiens
QLGEQCWTAR

SEQ ID NO: 3377 - protein, 10 aa, Homo sapiens
LGLLLWGPGQ

SEQ ID NO: 3378 - protein, 10 aa, Homo sapiens
GTALLCYSCK

SEQ ID NO: 3379 - protein, 10 aa, Homo sapiens
CCDTDLCNAS

SEQ ID NO: 3380 - protein, 10 aa, Homo sapiens
SQDYYVGKKN

SEQ ID NO: 3381 - protein, 10 aa, Homo sapiens
VPHPDPPMAL

SEQ ID NO: 3382 - protein, 10 aa, Homo sapiens
APVPHPDPPM

SEQ ID NO: 3383 - protein, 10 aa, Homo sapiens
MPCSRLPPSL

SEQ ID NO: 3384 - protein, 10 aa, Homo sapiens
SPAPSRGQAL

SEQ ID NO: 3385 - protein, 10 aa, Homo sapiens
VPEAHPNASL

SEQ ID NO: 3386 - protein, 10 aa, Homo sapiens
GVVPQASVPL

SEQ ID NO: 3387 - protein, 10 aa, Homo sapiens
VVPQASVPLL

SEQ ID NO: 3388 - protein, 10 aa, Homo sapiens
PPADGPSNPL

SEQ ID NO: 3389 - protein, 10 aa, Homo sapiens
ASYRLWGAPL

SEQ ID NO: 3390 - protein, 10 aa, Homo sapiens
APLQPTLGVV

SEQ ID NO: 3391 - protein, 10 aa, Homo sapiens
RLPPSLRCSL

SEQ ID NO: 3392 - protein, 10 aa, Homo sapiens
WARRTSRAVT

SEQ ID NO: 3393 - protein, 10 aa, Homo sapiens
GPAFSTLNPV

SEQ ID NO: 3394 - protein, 10 aa, Homo sapiens
HPNASLTMYV

SEQ ID NO: 3395 - protein, 10 aa, Homo sapiens
CSGDPASYRL

SEQ ID NO: 3396 - protein, 10 aa, Homo sapiens
HPAQWEPVLV

SEQ ID NO: 3397 - protein, 10 aa, Homo sapiens
STLNPVLRHL

SEQ ID NO: 3398 - protein, 10 aa, Homo sapiens
EAHPNASLTM

SEQ ID NO: 3399 - protein, 10 aa, Homo sapiens
QPTLGVVPQA

SEQ ID NO: 3400 - protein, 10 aa, Homo sapiens
VPQASVPLLT

SEQ ID NO: 3401 - protein, 10 aa, Homo sapiens
DPASYRLWGA

SEQ ID NO: 3402 - protein, 10 aa, Homo sapiens
AFPAHPIYDL

SEQ ID NO: 3403 - protein, 10 aa, Homo sapiens
PAGPMPCSRL

SEQ ID NO: 3404 - protein, 10 aa, Homo sapiens
ALSRTPTRQI

SEQ ID NO: 3405 - protein, 10 aa, Homo sapiens
AVTPTCATPA

SEQ ID NO: 3406 - protein, 10 aa, Homo sapiens
CSRLPPSLRC

SEQ ID NO: 3407 - protein, 10 aa, Homo sapiens
PAFSTLNPVL

SEQ ID NO: 3408 - protein, 10 aa, Homo sapiens
SLRCSLHSAC

SEQ ID NO: 3409 - protein, 10 aa, Homo sapiens
TSRAVTPTCA

SEQ ID NO: 3410 - protein, 10 aa, Homo sapiens
VLRHLFPQEA

SEQ ID NO: 3411 - protein, 10 aa, Homo sapiens
PPMALSRTPT

SEQ ID NO: 3412 - protein, 10 aa, Homo sapiens
GPMPCSRLPP

SEQ ID NO: 3413 - protein, 10 aa, Homo sapiens
GAPLQPTLGV

SEQ ID NO: 3414 - protein, 10 aa, Homo sapiens
APSRGQALRR

SEQ ID NO: 3415 - protein, 10 aa, Homo sapiens
HPIYDLSQVW

SEQ ID NO: 3416 - protein, 10 aa, Homo sapiens
RTPTRQIGSI

SEQ ID NO: 3417 - protein, 10 aa, Homo sapiens
THPAQWEPVL

SEQ ID NO: 3418 - protein, 10 aa, Homo sapiens
LWGAPLQPTL

SEQ ID NO: 3419 - protein, 10 aa, Homo sapiens
GPSNPLCCCF

SEQ ID NO: 3420 - protein, 10 aa, Homo sapiens
FPAHPIYDLS

SEQ ID NO: 3421 - protein, 10 aa, Homo sapiens
CFHGPAFSTL

SEQ ID NO: 3422 - protein, 10 aa, Homo sapiens
VPLLTHPAQW

SEQ ID NO: 3423 - protein, 10 aa, Homo sapiens
EPVLVPEAHP

SEQ ID NO: 3424 - protein, 10 aa, Homo sapiens
TLGVVPQASV

SEQ ID NO: 3425 - protein, 10 aa, Homo sapiens
CATPAGPMPC

SEQ ID NO: 3426 - protein, 10 aa, Homo sapiens
NASLTMYVCA

SEQ ID NO: 3427 - protein, 10 aa, Homo sapiens
ASVPLLTHPA

SEQ ID NO: 3428 - protein, 10 aa, Homo sapiens
DPPADGPSNP

SEQ ID NO: 3429 - protein, 10 aa, Homo sapiens
LPPSLRCSLH

SEQ ID NO: 3430 - protein, 10 aa, Homo sapiens
TPAGPMPCSR

SEQ ID NO: 3431 - protein, 10 aa, Homo sapiens
NPVLRHLFPQ

SEQ ID NO: 3432 - protein, 10 aa, Homo sapiens
DPPMALSRTP

SEQ ID NO: 3433 - protein, 10 aa, Homo sapiens
FPQEAFPAHP

SEQ ID NO: 3434 - protein, 10 aa, Homo sapiens
TPTCATPAGP

SEQ ID NO: 3435 - protein, 10 aa, Homo sapiens
NPLCCCFHGP

SEQ ID NO: 3436 - protein, 10 aa, Homo sapiens
SLTMYVCAPV

SEQ ID NO: 3437 - protein, 10 aa, Homo sapiens
TPTRQIGSID

SEQ ID NO: 3438 - protein, 10 aa, Homo sapiens
LTHPAQWEPV

SEQ ID NO: 3439 - protein, 10 aa, Homo sapiens
RLWGAPLQPT

SEQ ID NO: 3440 - protein, 10 aa, Homo sapiens
LSRTPTRQIG

SEQ ID NO: 3441 - protein, 10 aa, Homo sapiens
CCFHGPAFST

SEQ ID NO: 3442 - protein, 10 aa, Homo sapiens
DGPSNPLCCC

SEQ ID NO: 3443 - protein, 10 aa, Homo sapiens
VSPAPSRGQA

SEQ ID NO: 3444 - protein, 10 aa, Homo sapiens
PTCATPAGPM

SEQ ID NO: 3445 - protein, 10 aa, Homo sapiens
PSRGQALRRA

SEQ ID NO: 3446 - protein, 10 aa, Homo sapiens
HLFPQEAFPA

SEQ ID NO: 3447 - protein, 10 aa, Homo sapiens
RTSRAVTPTC

SEQ ID NO: 3448 - protein, 10 aa, Homo sapiens
TTWARRTSRA

SEQ ID NO: 3449 - protein, 10 aa, Homo sapiens
VLVPEAHPNA

SEQ ID NO: 3450 - protein, 10 aa, Homo sapiens
IGSIDTDPPA

SEQ ID NO: 3451 - protein, 10 aa, Homo sapiens
LVPEAHPNAS

SEQ ID NO: 3452 - protein, 10 aa, Homo sapiens
SQVWSVVSPA

SEQ ID NO: 3453 - protein, 10 aa, Homo sapiens
PTRQIGSIDT

SEQ ID NO: 3454 - protein, 10 aa, Homo sapiens
HSACCSGDPA

SEQ ID NO: 3455 - protein, 10 aa, Homo sapiens
ATPAGPMPCS

SEQ ID NO: 3456 - protein, 10 aa, Homo sapiens
VVSPAPSRGQ

SEQ ID NO: 3457 - protein, 10 aa, Homo sapiens
HPDPPMALSR

SEQ ID NO: 3458 - protein, 10 aa, Homo sapiens
AHPIYDLSQV

SEQ ID NO: 3459 - protein, 10 aa, Homo sapiens
SACCSGDPAS

SEQ ID NO: 3460 - protein, 10 aa, Homo sapiens
ACCSGDPASY

SEQ ID NO: 3461 - protein, 10 aa, Homo sapiens
PVPHPDPPMA

SEQ ID NO: 3462 - protein, 10 aa, Homo sapiens
SVPLLTHPAQ

SEQ ID NO: 3463 - protein, 10 aa, Homo sapiens
SVVSPAPSRG

SEQ ID NO: 3464 - protein, 10 aa, Homo sapiens
YVCAPVPHPD

SEQ ID NO: 3465 - protein, 10 aa, Homo sapiens
QVWSVVSPAP

SEQ ID NO: 3466 - protein, 10 aa, Homo sapiens
PPSLRCSLHS

SEQ ID NO: 3467 - protein, 10 aa, Homo sapiens
AGPMPCSRLP

SEQ ID NO: 3468 - protein, 10 aa, Homo sapiens
TLNPVLRHLF

SEQ ID NO: 3469 - protein, 10 aa, Homo sapiens
LTMYVCAPVP

SEQ ID NO: 3470 - protein, 10 aa, Homo sapiens
ASLTMYVCAP

SEQ ID NO: 3471 - protein, 10 aa, Homo sapiens
ADGPSNPLCC

SEQ ID NO: 3472 - protein, 10 aa, Homo sapiens
QASVPLLTHP

SEQ ID NO: 3473 - protein, 10 aa, Homo sapiens
ARRTSRAVTP

SEQ ID NO: 3474 - protein, 10 aa, Homo sapiens
AQWEPVLVPE

SEQ ID NO: 3475 - protein, 10 aa, Homo sapiens
RAVTPTCATP

SEQ ID NO: 3476 - protein, 10 aa, Homo sapiens
CAPVPHPDPP

SEQ ID NO: 3477 - protein, 10 aa, Homo sapiens
MALSRTPTRQ

SEQ ID NO: 3478 - protein, 10 aa, Homo sapiens
RTTTWARRTS

SEQ ID NO: 3479 - protein, 10 aa, Homo sapiens
EAFPAHPIYD

SEQ ID NO: 3480 - protein, 10 aa, Homo sapiens
YDLSQVWSVV

SEQ ID NO: 3481 - protein, 10 aa, Homo sapiens
MPCSRLLPSL

SEQ ID NO: 3482 - protein, 10 aa, Homo sapiens
AGPMPCSRLL

SEQ ID NO: 3483 - protein, 10 aa, Homo sapiens
RLLPSLRCSL

SEQ ID NO: 3484 - protein, 10 aa, Homo sapiens
CSRLLPSLRC

SEQ ID NO: 3485 - protein, 10 aa, Homo sapiens
GPMPCSRLLP

SEQ ID NO: 3486 - protein, 10 aa, Homo sapiens
LPSLRCSLHS

SEQ ID NO: 3487 - protein, 10 aa, Homo sapiens
LLPSLRCSLH

SEQ ID NO: 3488 - protein, 10 aa, Homo sapiens
PMPCSRLLPS

SEQ ID NO: 3489 - protein, 10 aa, Homo sapiens
SRLLPSLRCS

SEQ ID NO: 3490 - protein, 10 aa, Homo sapiens
PCSRLLPSLR

SEQ ID NO: 3491 - protein, 9 aa, Homo sapiens
SSRLWGAPL

SEQ ID NO: 3492 - protein, 10 aa, Homo sapiens
CSGDPASSRL

SEQ ID NO: 3493 - protein, 10 aa, Homo sapiens
DPASSRLWGA

SEQ ID NO: 3494 - protein, 10 aa, Homo sapiens
SSRLWGAPLQ

SEQ ID NO: 3495 - protein, 10 aa, Homo sapiens
ACCSGDPASS

SEQ ID NO: 3496 - protein, 10 aa, Homo sapiens
CCSGDPASSR

SEQ ID NO: 3497 - protein, 10 aa, Homo sapiens
SGDPASSRLW

SEQ ID NO: 3498 - protein, 10 aa, Homo sapiens
PASSRLWGAP

SEQ ID NO: 3499 - protein, 10 aa, Homo sapiens
GDPASSRLWG

SEQ ID NO: 3500 - protein, 10 aa, Homo sapiens
SRLWGAPLQP

SEQ ID NO: 3501 - protein, 10 aa, Homo sapiens
DPAQWEPVLV

SEQ ID NO: 3502 - protein, 10 aa, Homo sapiens
TDPAQWEPVL

SEQ ID NO: 3503 - protein, 10 aa, Homo sapiens
VPLLTDPAQW

SEQ ID NO: 3504 - protein, 10 aa, Homo sapiens
ASVPLLTDPA

SEQ ID NO: 3505 - protein, 10 aa, Homo sapiens
LTDPAQWEPV

SEQ ID NO: 3506 - protein, 10 aa, Homo sapiens
SVPLLTDPAQ

SEQ ID NO: 3507 - protein, 10 aa, Homo sapiens
QASVPLLTDP

SEQ ID NO: 3508 - protein, 10 aa, Homo sapiens
LLTDPAQWEP

SEQ ID NO: 3509 - protein, 10 aa, Homo sapiens
PLLTDPAQWE

SEQ ID NO: 3510 - protein, 10 aa, Homo sapiens
PQASVPLLTD

SEQ ID NO: 3511 - protein, 10 aa, Homo sapiens
QASVPLLTDL

SEQ ID NO: 3512 - protein, 10 aa, Homo sapiens
TDLAQWEPVL

SEQ ID NO: 3513 - protein, 10 aa, Homo sapiens
VPLLTDLAQW

SEQ ID NO: 3514 - protein, 10 aa, Homo sapiens
ASVPLLTDLA

SEQ ID NO: 3515 - protein, 10 aa, Homo sapiens
DLAQWEPVLV

SEQ ID NO: 3516 - protein, 10 aa, Homo sapiens
LTDLAQWEPV

SEQ ID NO: 3517 - protein, 10 aa, Homo sapiens
SVPLLTDLAQ

SEQ ID NO: 3518 - protein, 10 aa, Homo sapiens
LLTDLAQWEP

SEQ ID NO: 3519 - protein, 10 aa, Homo sapiens
PLLTDLAQWE

SEQ ID NO: 3520 - protein, 10 aa, Homo sapiens
QASVPLLTHL

SEQ ID NO: 3521 - protein, 10 aa, Homo sapiens
THLAQWEPVL

SEQ ID NO: 3522 - protein, 10 aa, Homo sapiens
VPLLTHLAQW

SEQ ID NO: 3523 - protein, 10 aa, Homo sapiens
ASVPLLTHLA

SEQ ID NO: 3524 - protein, 10 aa, Homo sapiens
LTHLAQWEPV

SEQ ID NO: 3525 - protein, 10 aa, Homo sapiens
HLAQWEPVLV

SEQ ID NO: 3526 - protein, 10 aa, Homo sapiens
SVPLLTHLAQ

SEQ ID NO: 3527 - protein, 10 aa, Homo sapiens
LAQWEPVLVP

SEQ ID NO: 3528 - protein, 10 aa, Homo sapiens
LLTHLAQWEP

SEQ ID NO: 3529 - protein, 10 aa, Homo sapiens
PLLTHLAQWE

SEQ ID NO: 3530 - protein, 10 aa, Homo sapiens
TPVPHPDPPM

SEQ ID NO: 3531 - protein, 10 aa, Homo sapiens
NASLTMYVCT

SEQ ID NO: 3532 - protein, 10 aa, Homo sapiens
SLTMYVCTPV

SEQ ID NO: 3533 - protein, 10 aa, Homo sapiens
YVCTPVPHPD

SEQ ID NO: 3534 - protein, 10 aa, Homo sapiens
ASLTMYVCTP

SEQ ID NO: 3535 - protein, 10 aa, Homo sapiens
LTMYVCTPVP

SEQ ID NO: 3536 - protein, 10 aa, Homo sapiens
VCTPVPHPDP

SEQ ID NO: 3537 - protein, 10 aa, Homo sapiens
CTPVPHPDPP

SEQ ID NO: 3538 - protein, 10 aa, Homo sapiens
TMYVCTPVPH

SEQ ID NO: 3539 - protein, 10 aa, Homo sapiens
MYVCTPVPHP

SEQ ID NO: 3540 - protein, 10 aa, Homo sapiens
RTPTRQISSI

SEQ ID NO: 3541 - protein, 10 aa, Homo sapiens
LSRTPTRQIS

SEQ ID NO: 3542 - protein, 10 aa, Homo sapiens
TPTRQISSID

SEQ ID NO: 3543 - protein, 10 aa, Homo sapiens
ISSIDTDPPA

SEQ ID NO: 3544 - protein, 10 aa, Homo sapiens
PTRQISSIDT

SEQ ID NO: 3545 - protein, 10 aa, Homo sapiens
SSIDTDPPAD

SEQ ID NO: 3546 - protein, 10 aa, Homo sapiens
RQISSIDTDP

SEQ ID NO: 3547 - protein, 10 aa, Homo sapiens
QISSIDTDPP

SEQ ID NO: 3548 - protein, 10 aa, Homo sapiens
SRTPTRQISS

SEQ ID NO: 3549 - protein, 10 aa, Homo sapiens
TRQISSIDTD

SEQ ID NO: 3550 - protein, 10 aa, Homo sapiens
TPTRQISSSD

SEQ ID NO: 3551 - protein, 10 aa, Homo sapiens
ISSSDTDPPA

SEQ ID NO: 3552 - protein, 10 aa, Homo sapiens
PTRQISSSDT

SEQ ID NO: 3553 - protein, 10 aa, Homo sapiens
RTPTRQISSS

SEQ ID NO: 3554 - protein, 10 aa, Homo sapiens
SSSDTDPPAD

SEQ ID NO: 3555 - protein, 10 aa, Homo sapiens
QISSSDTDPP

SEQ ID NO: 3556 - protein, 10 aa, Homo sapiens
RQISSSDTDP

SEQ ID NO: 3557 - protein, 10 aa, Homo sapiens
TRQISSSDTD

SEQ ID NO: 3558 - protein, 10 aa, Homo sapiens
TPTRQIGSSD

SEQ ID NO: 3559 - protein, 10 aa, Homo sapiens
PTRQIGSSDT

SEQ ID NO: 3560 - protein, 10 aa, Homo sapiens
IGSSDTDPPA

SEQ ID NO: 3561 - protein, 10 aa, Homo sapiens
RTPTRQIGSS

SEQ ID NO: 3562 - protein, 10 aa, Homo sapiens
GSSDTDPPAD

SEQ ID NO: 3563 - protein, 10 aa, Homo sapiens
QIGSSDTDPP

SEQ ID NO: 3564 - protein, 10 aa, Homo sapiens
RQIGSSDTDP

SEQ ID NO: 3565 - protein, 10 aa, Homo sapiens
SSDTDPPADG

SEQ ID NO: 3566 - protein, 10 aa, Homo sapiens
SDTDPPADGP

SEQ ID NO: 3567 - protein, 10 aa, Homo sapiens
TRQIGSSDTD

SEQ ID NO: 3568 - protein, 10 aa, Homo sapiens
PSRGQALRRA

SEQ ID NO: 3569 - protein, 10 aa, Homo sapiens
SRGQALRRAQ

SEQ ID NO: 3570 - protein, 9 aa, Homo sapiens
QPGTALLCY

SEQ ID NO: 3571 - protein, 9 aa, Homo sapiens
QPAAAILAL

SEQ ID NO: 3572 - protein, 9 aa, Homo sapiens
KAVLLALLM

SEQ ID NO: 3573 - protein, 9 aa, Homo sapiens
LPALGLLLW

SEQ ID NO: 3574 - protein, 9 aa, Homo sapiens
TARIRAVGL

SEQ ID NO: 3575 - protein, 9 aa, Homo sapiens
NCVDDSQDY

SEQ ID NO: 3576 - protein, 9 aa, Homo sapiens
LALLPALGL

SEQ ID NO: 3577 - protein, 9 aa, Homo sapiens
VSNEDCLQV

SEQ ID NO: 3578 - protein, 9 aa, Homo sapiens
LALQPGTAL

SEQ ID NO: 3579 - protein, 9 aa, Homo sapiens
RAVGLLTVI

SEQ ID NO: 3580 - protein, 9 aa, Homo sapiens
LQVENCTQL

SEQ ID NO: 3581 - protein, 9 aa, Homo sapiens
ISKGCSLNC

SEQ ID NO: 3582 - protein, 9 aa, Homo sapiens
CVDDSQDYY

SEQ ID NO: 3583 - protein, 9 aa, Homo sapiens
HALQPAAAI

SEQ ID NO: 3584 - protein, 9 aa, Homo sapiens
TVISKGCSL

SEQ ID NO: 3585 - protein, 9 aa, Homo sapiens
ALQPAAAIL

SEQ ID NO: 3586 - protein, 9 aa, Homo sapiens
ALLPALGLL

SEQ ID NO: 3587 - protein, 9 aa, Homo sapiens
AILALLPAL

SEQ ID NO: 3588 - protein, 9 aa, Homo sapiens
LLLWGPGQL

SEQ ID NO: 3589 - protein, 9 aa, Homo sapiens
NITCCDTDL

SEQ ID NO: 3590 - protein, 9 aa, Homo sapiens
ALQPGTALL

SEQ ID NO: 3591 - protein, 9 aa, Homo sapiens
AQVSNEDCL

SEQ ID NO: 3592 - protein, 9 aa, Homo sapiens
CNASGAHAL

SEQ ID NO: 3593 - protein, 9 aa, Homo sapiens
LLALLMAGL

SEQ ID NO: 3594 - protein, 9 aa, Homo sapiens
LLPALGLLL

SEQ ID NO: 3595 - protein, 9 aa, Homo sapiens
ALLMAGLAL

SEQ ID NO: 3596 - protein, 9 aa, Homo sapiens
RIRAVGLLT

SEQ ID NO: 3597 - protein, 9 aa, Homo sapiens
KAQVSNEDC

SEQ ID NO: 3598 - protein, 9 aa, Homo sapiens
YSCKAQVSN

SEQ ID NO: 3599 - protein, 9 aa, Homo sapiens
CTQLGEQCW

SEQ ID NO: 3600 - protein, 9 aa, Homo sapiens
CSLNCVDDS

SEQ ID NO: 3601 - protein, 9 aa, Homo sapiens
VGKKNITCC

SEQ ID NO: 3602 - protein, 9 aa, Homo sapiens
AAILALLPA

SEQ ID NO: 3603 - protein, 9 aa, Homo sapiens
PAAAILALL

SEQ ID NO: 3604 - protein, 9 aa, Homo sapiens
GAHALQPAA

SEQ ID NO: 3605 - protein, 9 aa, Homo sapiens
LALLMAGLA

SEQ ID NO: 3606 - protein, 9 aa, Homo sapiens
TCCDTDLCN

SEQ ID NO: 3607 - protein, 9 aa, Homo sapiens
QLGEQCWTA

SEQ ID NO: 3608 - protein, 9 aa, Homo sapiens
LCYSCKAQV

SEQ ID NO: 3609 - protein, 9 aa, Homo sapiens
TQLGEQCWT

SEQ ID NO: 3610 - protein, 9 aa, Homo sapiens
ITCCDTDLC

SEQ ID NO: 3611 - protein, 9 aa, Homo sapiens
LQPAAAILA

SEQ ID NO: 3612 - protein, 9 aa, Homo sapiens
LTVISKGCS

SEQ ID NO: 3613 - protein, 9 aa, Homo sapiens
YVGKKNITC

SEQ ID NO: 3614 - protein, 9 aa, Homo sapiens
GLALQPGTA

SEQ ID NO: 3615 - protein, 9 aa, Homo sapiens
DSQDYYVGK

SEQ ID NO: 3616 - protein, 9 aa, Homo sapiens
QCWTARIRA

SEQ ID NO: 3617 - protein, 9 aa, Homo sapiens
GTALLCYSC

SEQ ID NO: 3618 - protein, 9 aa, Homo sapiens
VISKGCSLN

SEQ ID NO: 3619 - protein, 9 aa, Homo sapiens
LQPGTALLC

SEQ ID NO: 3620 - protein, 9 aa, Homo sapiens
AVGLLTVIS

SEQ ID NO: 3621 - protein, 9 aa, Homo sapiens
AVLLALLMA

SEQ ID NO: 3622 - protein, 9 aa, Homo sapiens
MKAVLLALL

SEQ ID NO: 3623 - protein, 9 aa, Homo sapiens
ARIRAVGLL

SEQ ID NO: 3624 - protein, 9 aa, Homo sapiens
SGAHALQPA

SEQ ID NO: 3625 - protein, 9 aa, Homo sapiens
LCNASGAHA

SEQ ID NO: 3626 - protein, 9 aa, Homo sapiens
ALLCYSCKA

SEQ ID NO: 3627 - protein, 9 aa, Homo sapiens
LLTVISKGC

SEQ ID NO: 3628 - protein, 9 aa, Homo sapiens
DCLQVENCT

SEQ ID NO: 3629 - protein, 9 aa, Homo sapiens
NCTQLGEQC

SEQ ID NO: 3630 - protein, 9 aa, Homo sapiens
AGLALQPGT

SEQ ID NO: 3631 - protein, 9 aa, Homo sapiens
ASGAHALQP

SEQ ID NO: 3632 - protein, 9 aa, Homo sapiens
CCDTDLCNA

SEQ ID NO: 3633 - protein, 9 aa, Homo sapiens
GEQCWTARI

SEQ ID NO: 3634 - protein, 9 aa, Homo sapiens
DYYVGKKNI

SEQ ID NO: 3635 - protein, 9 aa, Homo sapiens
SCKAQVSNE

SEQ ID NO: 3636 - protein, 9 aa, Homo sapiens
TALLCYSCK

SEQ ID NO: 3637 - protein, 9 aa, Homo sapiens
NASGAHALQ

SEQ ID NO: 3638 - protein, 9 aa, Homo sapiens
AAAILALLP

SEQ ID NO: 3639 - protein, 9 aa, Homo sapiens
MAGLALQPG

SEQ ID NO: 3640 - protein, 9 aa, Homo sapiens
KGCSLNCVD

SEQ ID NO: 3641 - protein, 9 aa, Homo sapiens
SKGCSLNCV

SEQ ID NO: 3642 - protein, 9 aa, Homo sapiens
KNITCCDTD

SEQ ID NO: 3643 - protein, 9 aa, Homo sapiens
CDTDLCNAS

SEQ ID NO: 3644 - protein, 9 aa, Homo sapiens
IRAVGLLTV

SEQ ID NO: 3645 - protein, 9 aa, Homo sapiens
KKNITCCDT

SEQ ID NO: 3646 - protein, 9 aa, Homo sapiens
CWTARIRAV

SEQ ID NO: 3647 - protein, 9 aa, Homo sapiens
QVSNEDCLQ

SEQ ID NO: 3648 - protein, 9 aa, Homo sapiens
LNCVDDSQD

SEQ ID NO: 3649 - protein, 9 aa, Homo sapiens
CLQVENCTQ

SEQ ID NO: 3650 - protein, 9 aa, Homo sapiens
LGLLLWGPG

SEQ ID NO: 3651 - protein, 9 aa, Homo sapiens
DLCNASGAH

SEQ ID NO: 3652 - protein, 9 aa, Homo sapiens
GLLLWGPGQ

SEQ ID NO: 3653 - protein, 9 aa, Homo sapiens
EDCLQVENC

SEQ ID NO: 3654 - protein, 9 aa, Homo sapiens
LLCYSCKAQ

SEQ ID NO: 3655 - protein, 9 aa, Homo sapiens
SLNCVDDSQ

SEQ ID NO: 3656 - protein, 9 aa, Homo sapiens
GLLTVISKG

SEQ ID NO: 3657 - protein, 9 aa, Homo sapiens
CYSCKAQVS

SEQ ID NO: 3658 - protein, 9 aa, Homo sapiens
ALGLLLWGP

SEQ ID NO: 3659 - protein, 9 aa, Homo sapiens
PGTALLCYS

SEQ ID NO: 3660 - protein, 9 aa, Homo sapiens
VGLLTVISK

SEQ ID NO: 3661 - protein, 9 aa, Homo sapiens
WTARIRAVG

SEQ ID NO: 3662 - protein, 9 aa, Homo sapiens
LMAGLALQP

SEQ ID NO: 3663 - protein, 9 aa, Homo sapiens
ENCTQLGEQ

SEQ ID NO: 3664 - protein, 9 aa, Homo sapiens
GCSLNCVDD

SEQ ID NO: 3665 - protein, 9 aa, Homo sapiens
AHALQPAAA

SEQ ID NO: 3666 - protein, 9 aa, Homo sapiens
ILALLPALG

SEQ ID NO: 3667 - protein, 9 aa, Homo sapiens
LLMAGLALQ

SEQ ID NO: 3668 - protein, 9 aa, Homo sapiens
EQCWTARIR

SEQ ID NO: 3669 - protein, 9 aa, Homo sapiens
TDLCNASGA

SEQ ID NO: 3670 - protein, 9 aa, Homo sapiens
HPNASLTMY

SEQ ID NO: 3671 - protein, 9 aa, Homo sapiens
HPAQWEPVL

SEQ ID NO: 3672 - protein, 9 aa, Homo sapiens
LPPSLRCSL

SEQ ID NO: 3673 - protein, 9 aa, Homo sapiens
FPAHPIYDL

SEQ ID NO: 3674 - protein, 9 aa, Homo sapiens
VPQASVPLL

SEQ ID NO: 3675 - protein, 9 aa, Homo sapiens
TPTRQIGSI

SEQ ID NO: 3676 - protein, 9 aa, Homo sapiens
HPIYDLSQV

SEQ ID NO: 3677 - protein, 9 aa, Homo sapiens
EAFPAHPIY

SEQ ID NO: 3678 - protein, 9 aa, Homo sapiens
LSRTPTRQI

SEQ ID NO: 3679 - protein, 9 aa, Homo sapiens
APLQPTLGV

SEQ ID NO: 3680 - protein, 9 aa, Homo sapiens
DPPADGPSN

SEQ ID NO: 3681 - protein, 9 aa, Homo sapiens
VPHPDPPMA

SEQ ID NO: 3682 - protein, 9 aa, Homo sapiens
CCSGDPASY

SEQ ID NO: 3683 - protein, 9 aa, Homo sapiens
GPSNPLCCC

SEQ ID NO: 3684 - protein, 9 aa, Homo sapiens
MPCSRLPPS

SEQ ID NO: 3685 - protein, 9 aa, Homo sapiens
SPAPSRGQA

SEQ ID NO: 3686 - protein, 9 aa, Homo sapiens
TPAGPMPCS

SEQ ID NO: 3687 - protein, 9 aa, Homo sapiens
TCATPAGPM

SEQ ID NO: 3688 - protein, 9 aa, Homo sapiens
DPPMALSRT

SEQ ID NO: 3689 - protein, 9 aa, Homo sapiens
WARRTSRAV

SEQ ID NO: 3690 - protein, 9 aa, Homo sapiens
TSRAVTPTC

SEQ ID NO: 3691 - protein, 9 aa, Homo sapiens
LNPVLRHLF

SEQ ID NO: 3692 - protein, 9 aa, Homo sapiens
TLNPVLRHL

SEQ ID NO: 3693 - protein, 9 aa, Homo sapiens
VVPQASVPL

SEQ ID NO: 3694 - protein, 9 aa, Homo sapiens
GSIDTDPPA

SEQ ID NO: 3695 - protein, 9 aa, Homo sapiens
WGAPLQPTL

SEQ ID NO: 3696 - protein, 9 aa, Homo sapiens
AGPMPCSRL

SEQ ID NO: 3697 - protein, 9 aa, Homo sapiens
CCCFHGPAF

SEQ ID NO: 3698 - protein, 9 aa, Homo sapiens
HPDPPMALS

SEQ ID NO: 3699 - protein, 9 aa, Homo sapiens
VPEAHPNAS

SEQ ID NO: 3700 - protein, 9 aa, Homo sapiens
RAVTPTCAT

SEQ ID NO: 3701 - protein, 9 aa, Homo sapiens
PSNPLCCCF

SEQ ID NO: 3702 - protein, 9 aa, Homo sapiens
ASLTMYVCA

SEQ ID NO: 3703 - protein, 9 aa, Homo sapiens
CSLHSACCS

SEQ ID NO: 3704 - protein, 9 aa, Homo sapiens
WSVVSPAPS

SEQ ID NO: 3705 - protein, 9 aa, Homo sapiens
LSQVWSVVS

SEQ ID NO: 3706 - protein, 9 aa, Homo sapiens
FPQEAFPAH

SEQ ID NO: 3707 - protein, 9 aa, Homo sapiens
SLRCSLHSA

SEQ ID NO: 3708 - protein, 9 aa, Homo sapiens
NASLTMYVC

SEQ ID NO: 3709 - protein, 9 aa, Homo sapiens
EAHPNASLT

SEQ ID NO: 3710 - protein, 9 aa, Homo sapiens
PAPSRGQAL

SEQ ID NO: 3711 - protein, 9 aa, Homo sapiens
SGDPASYRL

SEQ ID NO: 3712 - protein, 9 aa, Homo sapiens
SACCSGDPA

SEQ ID NO: 3713 - protein, 9 aa, Homo sapiens
SYRLWGAPL

SEQ ID NO: 3714 - protein, 9 aa, Homo sapiens
RHLFPQEAF

SEQ ID NO: 3715 - protein, 9 aa, Homo sapiens
VPLLTHPAQ

SEQ ID NO: 3716 - protein, 9 aa, Homo sapiens
RTPTRQIGS

SEQ ID NO: 3717 - protein, 9 aa, Homo sapiens
LGVVPQASV

SEQ ID NO: 3718 - protein, 9 aa, Homo sapiens
RTSRAVTPT

SEQ ID NO: 3719 - protein, 9 aa, Homo sapiens
NPLCCCFHG

SEQ ID NO: 3720 - protein, 9 aa, Homo sapiens
DLSQVWSVV

SEQ ID NO: 3721 - protein, 9 aa, Homo sapiens
EPVLVPEAH

SEQ ID NO: 3722 - protein, 9 aa, Homo sapiens
NPVLRHLFP

SEQ ID NO: 3723 - protein, 9 aa, Homo sapiens
GPMPCSRLP

SEQ ID NO: 3724 - protein, 9 aa, Homo sapiens
APSRGQALR

SEQ ID NO: 3725 - protein, 9 aa, Homo sapiens
QPTLGVVPQ

SEQ ID NO: 3726 - protein, 9 aa, Homo sapiens
AHPNASLTM

SEQ ID NO: 3727 - protein, 9 aa, Homo sapiens
LTMYVCAPV

SEQ ID NO: 3728 - protein, 9 aa, Homo sapiens
APVPHPDPP

SEQ ID NO: 3729 - protein, 9 aa, Homo sapiens
TPTCATPAG

SEQ ID NO: 3730 - protein, 9 aa, Homo sapiens
DPASYRLWG

SEQ ID NO: 3731 - protein, 9 aa, Homo sapiens
RLPPSLRCS

SEQ ID NO: 3732 - protein, 9 aa, Homo sapiens
PVPHPDPPM

SEQ ID NO: 3733 - protein, 9 aa, Homo sapiens
RCSLHSACC

SEQ ID NO: 3734 - protein, 9 aa, Homo sapiens
RTTTWARRT

SEQ ID NO: 3735 - protein, 9 aa, Homo sapiens
LVPEAHPNA

SEQ ID NO: 3736 - protein, 9 aa, Homo sapiens
GPAFSTLNP

SEQ ID NO: 3737 - protein, 9 aa, Homo sapiens
CSRLPPSLR

SEQ ID NO: 3738 - protein, 9 aa, Homo sapiens
VLVPEAHPN

SEQ ID NO: 3739 - protein, 9 aa, Homo sapiens
ATPAGPMPC

SEQ ID NO: 3740 - protein, 9 aa, Homo sapiens
VTPTCATPA

SEQ ID NO: 3741 - protein, 9 aa, Homo sapiens
AFSTLNPVL

SEQ ID NO: 3742 - protein, 9 aa, Homo sapiens
LCCCFHGPA

SEQ ID NO: 3743 - protein, 9 aa, Homo sapiens
MTHRTTTWA

SEQ ID NO: 3744 - protein, 9 aa, Homo sapiens
FHGPAFSTL

SEQ ID NO: 3745 - protein, 9 aa, Homo sapiens
CSGDPASYR

SEQ ID NO: 3746 - protein, 9 aa, Homo sapiens
PCSRLPPSL

SEQ ID NO: 3747 - protein, 9 aa, Homo sapiens
TTTWARRTS

SEQ ID NO: 3748 - protein, 9 aa, Homo sapiens
PIYDLSQVW

SEQ ID NO: 3749 - protein, 9 aa, Homo sapiens
SVPLLTHPA

SEQ ID NO: 3750 - protein, 9 aa, Homo sapiens
ACCSGDPAS

SEQ ID NO: 3751 - protein, 9 aa, Homo sapiens
TLGVVPQAS

SEQ ID NO: 3752 - protein, 9 aa, Homo sapiens
QVWSVVSPA

SEQ ID NO: 3753 - protein, 9 aa, Homo sapiens
DGPSNPLCC

SEQ ID NO: 3754 - protein, 9 aa, Homo sapiens
CCFHGPAFS

SEQ ID NO: 3755 - protein, 9 aa, Homo sapiens
HGPAFSTLN

SEQ ID NO: 3756 - protein, 9 aa, Homo sapiens
PADGPSNPL

SEQ ID NO: 3757 - protein, 9 aa, Homo sapiens
PAQWEPVLV

SEQ ID NO: 3758 - protein, 9 aa, Homo sapiens
PAFSTLNPV

SEQ ID NO: 3759 - protein, 9 aa, Homo sapiens
ASVPLLTHP

SEQ ID NO: 3760 - protein, 9 aa, Homo sapiens
FSTLNPVLR

SEQ ID NO: 3761 - protein, 9 aa, Homo sapiens
PLLTHPAQW

SEQ ID NO: 3762 - protein, 9 aa, Homo sapiens
VSPAPSRGQ

SEQ ID NO: 3763 - protein, 9 aa, Homo sapiens
GDPASYRLW

SEQ ID NO: 3764 - protein, 9 aa, Homo sapiens
PSLRCSLHS

SEQ ID NO: 3765 - protein, 9 aa, Homo sapiens
ASYRLWGAP

SEQ ID NO: 3766 - protein, 9 aa, Homo sapiens
HSACCSGDP

SEQ ID NO: 3767 - protein, 9 aa, Homo sapiens
QEAFPAHPI

SEQ ID NO: 3768 - protein, 9 aa, Homo sapiens
PPADGPSNP

SEQ ID NO: 3769 - protein, 9 aa, Homo sapiens
VLRHLFPQE

SEQ ID NO: 3770 - protein, 9 aa, Homo sapiens
GPMPCSRLL

SEQ ID NO: 3771 - protein, 9 aa, Homo sapiens
MPCSRLLPS

SEQ ID NO: 3772 - protein, 9 aa, Homo sapiens
LLPSLRCSL

SEQ ID NO: 3773 - protein, 9 aa, Homo sapiens
RLLPSLRCS

SEQ ID NO: 3774 - protein, 9 aa, Homo sapiens
LPSLRCSLH

SEQ ID NO: 3775 - protein, 9 aa, Homo sapiens
CSRLLPSLR

SEQ ID NO: 3776 - protein, 9 aa, Homo sapiens
PCSRLLPSL

SEQ ID NO: 3777 - protein, 9 aa, Homo sapiens
SRLLPSLRC

SEQ ID NO: 3778 - protein, 9 aa, Homo sapiens
PMPCSRLLP

SEQ ID NO: 3779 - protein, 9 aa, Homo sapiens
SSRLWGAPL

SEQ ID NO: 3780 - protein, 9 aa, Homo sapiens
SGDPASSRL

SEQ ID NO: 3781 - protein, 9 aa, Homo sapiens
DPASSRLWG

SEQ ID NO: 3782 - protein, 9 aa, Homo sapiens
CCSGDPASS

SEQ ID NO: 3783 - protein, 9 aa, Homo sapiens
CSGDPASSR

SEQ ID NO: 3784 - protein, 9 aa, Homo sapiens
GDPASSRLW

SEQ ID NO: 3785 - protein, 9 aa, Homo sapiens
ASSRLWGAP

SEQ ID NO: 3786 - protein, 9 aa, Homo sapiens
PASSRLWGA

SEQ ID NO: 3787 - protein, 9 aa, Homo sapiens
SRLWGAPLQ

SEQ ID NO: 3788 - protein, 9 aa, Homo sapiens
DPAQWEPVL

SEQ ID NO: 3789 - protein, 9 aa, Homo sapiens
VPLLTDPAQ

SEQ ID NO: 3790 - protein, 9 aa, Homo sapiens
SVPLLTDPA

SEQ ID NO: 3791 - protein, 9 aa, Homo sapiens
PLLTDPAQW

SEQ ID NO: 3792 - protein, 9 aa, Homo sapiens
ASVPLLTDP

SEQ ID NO: 3793 - protein, 9 aa, Homo sapiens
QASVPLLTD

SEQ ID NO: 3794 - protein, 9 aa, Homo sapiens
LLTDPAQWE

SEQ ID NO: 3795 - protein, 9 aa, Homo sapiens
TDPAQWEPV

SEQ ID NO: 3796 - protein, 9 aa, Homo sapiens
LTDPAQWEP

SEQ ID NO: 3797 - protein, 9 aa, Homo sapiens
ASVPLLTDL

SEQ ID NO: 3798 - protein, 9 aa, Homo sapiens
DLAQWEPVL

SEQ ID NO: 3799 - protein, 9 aa, Homo sapiens
VPLLTDLAQ

SEQ ID NO: 3800 - protein, 9 aa, Homo sapiens
SVPLLTDLA

SEQ ID NO: 3801 - protein, 9 aa, Homo sapiens
PLLTDLAQW

SEQ ID NO: 3802 - protein, 9 aa, Homo sapiens
TDLAQWEPV

SEQ ID NO: 3803 - protein, 9 aa, Homo sapiens
LLTDLAQWE

SEQ ID NO: 3804 - protein, 9 aa, Homo sapiens
LTDLAQWEP

SEQ ID NO: 3805 - protein, 9 aa, Homo sapiens
ASVPLLTHL

SEQ ID NO: 3806 - protein, 9 aa, Homo sapiens
HLAQWEPVL

SEQ ID NO: 3807 - protein, 9 aa, Homo sapiens
LAQWEPVLV

SEQ ID NO: 3808 - protein, 9 aa, Homo sapiens
VPLLTHLAQ

SEQ ID NO: 3809 - protein, 9 aa, Homo sapiens
SVPLLTHLA

SEQ ID NO: 3810 - protein, 9 aa, Homo sapiens
PLLTHLAQW

SEQ ID NO: 3811 - protein, 9 aa, Homo sapiens
THLAQWEPV

SEQ ID NO: 3812 - protein, 9 aa, Homo sapiens
LTHLAQWEP

SEQ ID NO: 3813 - protein, 9 aa, Homo sapiens
LLTHLAQWE

SEQ ID NO: 3814 - protein, 9 aa, Homo sapiens
ASLTMYVCT

SEQ ID NO: 3815 - protein, 9 aa, Homo sapiens
LTMYVCTPV

SEQ ID NO: 3816 - protein, 9 aa, Homo sapiens
VCTPVPHPD

SEQ ID NO: 3817 - protein, 9 aa, Homo sapiens
YVCTPVPHP

SEQ ID NO: 3818 - protein, 9 aa, Homo sapiens
TMYVCTPVP

SEQ ID NO: 3819 - protein, 9 aa, Homo sapiens
CTPVPHPDP

SEQ ID NO: 3820 - protein, 9 aa, Homo sapiens
SLTMYVCTP

SEQ ID NO: 3821 - protein, 9 aa, Homo sapiens
MYVCTPVPH

SEQ ID NO: 3822 - protein, 9 aa, Homo sapiens
TPTRQISSI

SEQ ID NO: 3823 - protein, 9 aa, Homo sapiens
SSIDTDPPA

SEQ ID NO: 3824 - protein, 9 aa, Homo sapiens
RTPTRQISS

SEQ ID NO: 3825 - protein, 9 aa, Homo sapiens
ISSIDTDPP

SEQ ID NO: 3826 - protein, 9 aa, Homo sapiens
RQISSIDTD

SEQ ID NO: 3827 - protein, 9 aa, Homo sapiens
QISSIDTDP

SEQ ID NO: 3828 - protein, 9 aa, Homo sapiens
TRQISSIDT

SEQ ID NO: 3829 - protein, 9 aa, Homo sapiens
SRTPTRQIS

SEQ ID NO: 3830 - protein, 9 aa, Homo sapiens
PTRQISSID

SEQ ID NO: 3831 - protein, 9 aa, Homo sapiens
TPTRQISSS

SEQ ID NO: 3832 - protein, 9 aa, Homo sapiens
SSSDTDPPA

SEQ ID NO: 3833 - protein, 9 aa, Homo sapiens
ISSSDTDPP

SEQ ID NO: 3834 - protein, 9 aa, Homo sapiens
RQISSSDTD

SEQ ID NO: 3835 - protein, 9 aa, Homo sapiens
QISSSDTDP

SEQ ID NO: 3836 - protein, 9 aa, Homo sapiens
TRQISSSDT

SEQ ID NO: 3837 - protein, 9 aa, Homo sapiens
PTRQISSSD

SEQ ID NO: 3838 - protein, 9 aa, Homo sapiens
TPTRQIGSS

SEQ ID NO: 3839 - protein, 9 aa, Homo sapiens
GSSDTDPPA

SEQ ID NO: 3840 - protein, 9 aa, Homo sapiens
SSDTDPPAD

SEQ ID NO: 3841 - protein, 9 aa, Homo sapiens
RQIGSSDTD

SEQ ID NO: 3842 - protein, 9 aa, Homo sapiens
IGSSDTDPP

SEQ ID NO: 3843 - protein, 9 aa, Homo sapiens
QIGSSDTDP

SEQ ID NO: 3844 - protein, 9 aa, Homo sapiens
TRQIGSSDT

SEQ ID NO: 3845 - protein, 9 aa, Homo sapiens
PTRQIGSSD

SEQ ID NO: 3846 - protein, 9 aa, Homo sapiens
SDTDPPADG

SEQ ID NO: 3847 - protein, 9 aa, Homo sapiens
RGQALRRAQ

SEQ ID NO: 3848 - protein, 9 aa, Homo sapiens
SRGQALRRA

SEQ ID NO: 3849 - protein, 10 aa, Homo sapiens
QPAAAILALL

SEQ ID NO: 3850 - protein, 10 aa, Homo sapiens
TARIRAVGLL

SEQ ID NO: 3851 - protein, 10 aa, Homo sapiens
KAQVSNEDCL

SEQ ID NO: 3852 - protein, 10 aa, Homo sapiens
NCVDDSQDYY

SEQ ID NO: 3853 - protein, 10 aa, Homo sapiens
HALQPAAAIL

SEQ ID NO: 3854 - protein, 10 aa, Homo sapiens
LALLMAGLAL

SEQ ID NO: 3855 - protein, 10 aa, Homo sapiens
ISKGCSLNCV

SEQ ID NO: 3856 - protein, 10 aa, Homo sapiens
AAILALLPAL

SEQ ID NO: 3857 - protein, 10 aa, Homo sapiens
LALLPALGLL

SEQ ID NO: 3858 - protein, 10 aa, Homo sapiens
LALQPGTALL

SEQ ID NO: 3859 - protein, 10 aa, Homo sapiens
LNCVDDSQDY

SEQ ID NO: 3860 - protein, 10 aa, Homo sapiens
KNITCCDTDL

SEQ ID NO: 3861 - protein, 10 aa, Homo sapiens
QPGTALLCYS

SEQ ID NO: 3862 - protein, 10 aa, Homo sapiens
LQPGTALLCY

SEQ ID NO: 3863 - protein, 10 aa, Homo sapiens
RIRAVGLLTV

SEQ ID NO: 3864 - protein, 10 aa, Homo sapiens
LQPAAAILAL

SEQ ID NO: 3865 - protein, 10 aa, Homo sapiens
ALLPALGLLL

SEQ ID NO: 3866 - protein, 10 aa, Homo sapiens
GLLLWGPGQL

SEQ ID NO: 3867 - protein, 10 aa, Homo sapiens
LTVISKGCSL

SEQ ID NO: 3868 - protein, 10 aa, Homo sapiens
ILALLPALGL

SEQ ID NO: 3869 - protein, 10 aa, Homo sapiens
VLLALLMAGL

SEQ ID NO: 3870 - protein, 10 aa, Homo sapiens
WTARIRAVGL

SEQ ID NO: 3871 - protein, 10 aa, Homo sapiens
LCNASGAHAL

SEQ ID NO: 3872 - protein, 10 aa, Homo sapiens
GLALQPGTAL

SEQ ID NO: 3873 - protein, 10 aa, Homo sapiens
CLQVENCTQL

SEQ ID NO: 3874 - protein, 10 aa, Homo sapiens
RAVGLLTVIS

SEQ ID NO: 3875 - protein, 10 aa, Homo sapiens
KAVLLALLMA

SEQ ID NO: 3876 - protein, 10 aa, Homo sapiens
LLPALGLLLW

SEQ ID NO: 3877 - protein, 10 aa, Homo sapiens
ASGAHALQPA

SEQ ID NO: 3878 - protein, 10 aa, Homo sapiens
NCTQLGEQCW

SEQ ID NO: 3879 - protein, 10 aa, Homo sapiens
MAGLALQPGT

SEQ ID NO: 3880 - protein, 10 aa, Homo sapiens
TALLCYSCKA

SEQ ID NO: 3881 - protein, 10 aa, Homo sapiens
GAHALQPAAA

SEQ ID NO: 3882 - protein, 10 aa, Homo sapiens
AAAILALLPA

SEQ ID NO: 3883 - protein, 10 aa, Homo sapiens
TCCDTDLCNA

SEQ ID NO: 3884 - protein, 10 aa, Homo sapiens
QVSNEDCLQV

SEQ ID NO: 3885 - protein, 10 aa, Homo sapiens
LLCYSCKAQV

SEQ ID NO: 3886 - protein, 10 aa, Homo sapiens
MKAVLLALLM

SEQ ID NO: 3887 - protein, 10 aa, Homo sapiens
QCWTARIRAV

SEQ ID NO: 3888 - protein, 10 aa, Homo sapiens
LPALGLLLWG

SEQ ID NO: 3889 - protein, 10 aa, Homo sapiens
CTQLGEQCWT

SEQ ID NO: 3890 - protein, 10 aa, Homo sapiens
NITCCDTDLC

SEQ ID NO: 3891 - protein, 10 aa, Homo sapiens
LGEQCWTARI

SEQ ID NO: 3892 - protein, 10 aa, Homo sapiens
CVDDSQDYYV

SEQ ID NO: 3893 - protein, 10 aa, Homo sapiens
ALQPGTALLC

SEQ ID NO: 3894 - protein, 10 aa, Homo sapiens
LLTVISKGCS

SEQ ID NO: 3895 - protein, 10 aa, Homo sapiens
DSQDYYVGKK

SEQ ID NO: 3896 - protein, 10 aa, Homo sapiens
LLALLMAGLA

SEQ ID NO: 3897 - protein, 10 aa, Homo sapiens
TQLGEQCWTA

SEQ ID NO: 3898 - protein, 10 aa, Homo sapiens
ITCCDTDLCN

SEQ ID NO: 3899 - protein, 10 aa, Homo sapiens
VISKGCSLNC

SEQ ID NO: 3900 - protein, 10 aa, Homo sapiens
GCSLNCVDDS

SEQ ID NO: 3901 - protein, 10 aa, Homo sapiens
LCYSCKAQVS

SEQ ID NO: 3902 - protein, 10 aa, Homo sapiens
SGAHALQPAA

SEQ ID NO: 3903 - protein, 10 aa, Homo sapiens
YVGKKNITCC

SEQ ID NO: 3904 - protein, 10 aa, Homo sapiens
DLCNASGAHA

SEQ ID NO: 3905 - protein, 10 aa, Homo sapiens
EQCWTARIRA

SEQ ID NO: 3906 - protein, 10 aa, Homo sapiens
VSNEDCLQVE

SEQ ID NO: 3907 - protein, 10 aa, Homo sapiens
ALQPAAAILA

SEQ ID NO: 3908 - protein, 10 aa, Homo sapiens
GLLTVISKGC

SEQ ID NO: 3909 - protein, 10 aa, Homo sapiens
TVISKGCSLN

SEQ ID NO: 3910 - protein, 10 aa, Homo sapiens
ENCTQLGEQC

SEQ ID NO: 3911 - protein, 10 aa, Homo sapiens
AGLALQPGTA

SEQ ID NO: 3912 - protein, 10 aa, Homo sapiens
SNEDCLQVEN

SEQ ID NO: 3913 - protein, 10 aa, Homo sapiens
YSCKAQVSNE

SEQ ID NO: 3914 - protein, 10 aa, Homo sapiens
CSLNCVDDSQ

SEQ ID NO: 3915 - protein, 10 aa, Homo sapiens
AHALQPAAAI

SEQ ID NO: 3916 - protein, 10 aa, Homo sapiens
QDYYVGKKNI

SEQ ID NO: 3917 - protein, 10 aa, Homo sapiens
IRAVGLLTVI

SEQ ID NO: 3918 - protein, 10 aa, Homo sapiens
SCKAQVSNED

SEQ ID NO: 3919 - protein, 10 aa, Homo sapiens
VGKKNITCCD

SEQ ID NO: 3920 - protein, 10 aa, Homo sapiens
NASGAHALQP

SEQ ID NO: 3921 - protein, 10 aa, Homo sapiens
GKKNITCCDT

SEQ ID NO: 3922 - protein, 10 aa, Homo sapiens
SQDYYVGKKN

SEQ ID NO: 3923 - protein, 10 aa, Homo sapiens
CCDTDLCNAS

SEQ ID NO: 3924 - protein, 10 aa, Homo sapiens
DTDLCNASGA

SEQ ID NO: 3925 - protein, 10 aa, Homo sapiens
LQVENCTQLG

SEQ ID NO: 3926 - protein, 10 aa, Homo sapiens
KGCSLNCVDD

SEQ ID NO: 3927 - protein, 10 aa, Homo sapiens
QLGEQCWTAR

SEQ ID NO: 3928 - protein, 10 aa, Homo sapiens
AQVSNEDCLQ

SEQ ID NO: 3929 - protein, 10 aa, Homo sapiens
DCLQVENCTQ

SEQ ID NO: 3930 - protein, 10 aa, Homo sapiens
SLNCVDDSQD

SEQ ID NO: 3931 - protein, 10 aa, Homo sapiens
AILALLPALG

SEQ ID NO: 3932 - protein, 10 aa, Homo sapiens
DYYVGKKNIT

SEQ ID NO: 3933 - protein, 10 aa, Homo sapiens
EDCLQVENCT

SEQ ID NO: 3934 - protein, 10 aa, Homo sapiens
CKAQVSNEDC

SEQ ID NO: 3935 - protein, 10 aa, Homo sapiens
VGLLTVISKG

SEQ ID NO: 3936 - protein, 10 aa, Homo sapiens
ALGLLLWGPG

SEQ ID NO: 3937 - protein, 10 aa, Homo sapiens
AVLLALLMAG

SEQ ID NO: 3938 - protein, 10 aa, Homo sapiens
AVGLLTVISK

SEQ ID NO: 3939 - protein, 10 aa, Homo sapiens
LMAGLALQPG

SEQ ID NO: 3940 - protein, 10 aa, Homo sapiens
ARIRAVGLLT

SEQ ID NO: 3941 - protein, 10 aa, Homo sapiens
ALLCYSCKAQ

SEQ ID NO: 3942 - protein, 10 aa, Homo sapiens
CNASGAHALQ

SEQ ID NO: 3943 - protein, 10 aa, Homo sapiens
LLMAGLALQP

SEQ ID NO: 3944 - protein, 10 aa, Homo sapiens
LGLLLWGPGQ

SEQ ID NO: 3945 - protein, 10 aa, Homo sapiens
GTALLCYSCK

SEQ ID NO: 3946 - protein, 10 aa, Homo sapiens
ALLMAGLALQ

SEQ ID NO: 3947 - protein, 10 aa, Homo sapiens
YYVGKKNITC

SEQ ID NO: 3948 - protein, 10 aa, Homo sapiens
CYSCKAQVSN

SEQ ID NO: 3949 - protein, 10 aa, Homo sapiens
APVPHPDPPM

SEQ ID NO: 3950 - protein, 10 aa, Homo sapiens
GPSNPLCCCF

SEQ ID NO: 3951 - protein, 10 aa, Homo sapiens
SPAPSRGQAL

SEQ ID NO: 3952 - protein, 10 aa, Homo sapiens
MPCSRLPPSL

SEQ ID NO: 3953 - protein, 10 aa, Homo sapiens
VPHPDPPMAL

SEQ ID NO: 3954 - protein, 10 aa, Homo sapiens
CSGDPASYRL

SEQ ID NO: 3955 - protein, 10 aa, Homo sapiens
HPIYDLSQVW

SEQ ID NO: 3956 - protein, 10 aa, Homo sapiens
VPLLTHPAQW

SEQ ID NO: 3957 - protein, 10 aa, Homo sapiens
VPEAHPNASL

SEQ ID NO: 3958 - protein, 10 aa, Homo sapiens
EAHPNASLTM

SEQ ID NO: 3959 - protein, 10 aa, Homo sapiens
HPAQWEPVLV

SEQ ID NO: 3960 - protein, 10 aa, Homo sapiens
ASYRLWGAPL

SEQ ID NO: 3961 - protein, 10 aa, Homo sapiens
GPAFSTLNPV

SEQ ID NO: 3962 - protein, 10 aa, Homo sapiens
APLQPTLGVV

SEQ ID NO: 3963 - protein, 10 aa, Homo sapiens
HPNASLTMYV

SEQ ID NO: 3964 - protein, 10 aa, Homo sapiens
PPADGPSNPL

SEQ ID NO: 3965 - protein, 10 aa, Homo sapiens
ACCSGDPASY

SEQ ID NO: 3966 - protein, 10 aa, Homo sapiens
QPTLGVVPQA

SEQ ID NO: 3967 - protein, 10 aa, Homo sapiens
VPQASVPLLT

SEQ ID NO: 3968 - protein, 10 aa, Homo sapiens
RLPPSLRCSL

SEQ ID NO: 3969 - protein, 10 aa, Homo sapiens
FPAHPIYDLS

SEQ ID NO: 3970 - protein, 10 aa, Homo sapiens
DPASYRLWGA

SEQ ID NO: 3971 - protein, 10 aa, Homo sapiens
TSRAVTPTCA

SEQ ID NO: 3972 - protein, 10 aa, Homo sapiens
CSRLPPSLRC

SEQ ID NO: 3973 - protein, 10 aa, Homo sapiens
LCCCFHGPAF

SEQ ID NO: 3974 - protein, 10 aa, Homo sapiens
VVPQASVPLL

SEQ ID NO: 3975 - protein, 10 aa, Homo sapiens
TLNPVLRHLF

SEQ ID NO: 3976 - protein, 10 aa, Homo sapiens
GVVPQASVPL

SEQ ID NO: 3977 - protein, 10 aa, Homo sapiens
STLNPVLRHL

SEQ ID NO: 3978 - protein, 10 aa, Homo sapiens
WARRTSRAVT

SEQ ID NO: 3979 - protein, 10 aa, Homo sapiens
RTPTRQIGSI

SEQ ID NO: 3980 - protein, 10 aa, Homo sapiens
GAPLQPTLGV

SEQ ID NO: 3981 - protein, 10 aa, Homo sapiens
ASVPLLTHPA

SEQ ID NO: 3982 - protein, 10 aa, Homo sapiens
VSPAPSRGQA

SEQ ID NO: 3983 - protein, 10 aa, Homo sapiens
HSACCSGDPA

SEQ ID NO: 3984 - protein, 10 aa, Homo sapiens
FPQEAFPAHP

SEQ ID NO: 3985 - protein, 10 aa, Homo sapiens
ALSRTPTRQI

SEQ ID NO: 3986 - protein, 10 aa, Homo sapiens
SLRCSLHSAC

SEQ ID NO: 3987 - protein, 10 aa, Homo sapiens
CATPAGPMPC

SEQ ID NO: 3988 - protein, 10 aa, Homo sapiens
NASLTMYVCA

SEQ ID NO: 3989 - protein, 10 aa, Homo sapiens
PAFSTLNPVL

SEQ ID NO: 3990 - protein, 10 aa, Homo sapiens
VLRHLFPQEA

SEQ ID NO: 3991 - protein, 10 aa, Homo sapiens
SACCSGDPAS

SEQ ID NO: 3992 - protein, 10 aa, Homo sapiens
PAGPMPCSRL

SEQ ID NO: 3993 - protein, 10 aa, Homo sapiens
RLWGAPLQPT

SEQ ID NO: 3994 - protein, 10 aa, Homo sapiens
LPPSLRCSLH

SEQ ID NO: 3995 - protein, 10 aa, Homo sapiens
DPPADGPSNP

SEQ ID NO: 3996 - protein, 10 aa, Homo sapiens
LTHPAQWEPV

SEQ ID NO: 3997 - protein, 10 aa, Homo sapiens
RTSRAVTPTC

SEQ ID NO: 3998 - protein, 10 aa, Homo sapiens
NPVLRHLFPQ

SEQ ID NO: 3999 - protein, 10 aa, Homo sapiens
PTCATPAGPM

SEQ ID NO: 4000 - protein, 10 aa, Homo sapiens
EPVLVPEAHP

SEQ ID NO: 4001 - protein, 10 aa, Homo sapiens
LVPEAHPNAS

SEQ ID NO: 4002 - protein, 10 aa, Homo sapiens
DPPMALSRTP

SEQ ID NO: 4003 - protein, 10 aa, Homo sapiens
GPMPCSRLPP

SEQ ID NO: 4004 - protein, 10 aa, Homo sapiens
PPSLRCSLHS

SEQ ID NO: 4005 - protein, 10 aa, Homo sapiens
APSRGQALRR

SEQ ID NO: 4006 - protein, 10 aa, Homo sapiens
TPAGPMPCSR

SEQ ID NO: 4007 - protein, 10 aa, Homo sapiens
RTTTWARRTS

SEQ ID NO: 4008 - protein, 10 aa, Homo sapiens
TPTCATPAGP

SEQ ID NO: 4009 - protein, 10 aa, Homo sapiens
SLTMYVCAPV

SEQ ID NO: 4010 - protein, 10 aa, Homo sapiens
RCSLHSACCS

SEQ ID NO: 4011 - protein, 10 aa, Homo sapiens
NPLCCCFHGP

SEQ ID NO: 4012 - protein, 10 aa, Homo sapiens
TLGVVPQASV

SEQ ID NO: 4013 - protein, 10 aa, Homo sapiens
QEAFPAHPIY

SEQ ID NO: 4014 - protein, 10 aa, Homo sapiens
AHPNASLTMY

SEQ ID NO: 4015 - protein, 10 aa, Homo sapiens
PPMALSRTPT

SEQ ID NO: 4016 - protein, 10 aa, Homo sapiens
TPTRQIGSID

SEQ ID NO: 4017 - protein, 10 aa, Homo sapiens
GSIDTDPPAD

SEQ ID NO: 4018 - protein, 10 aa, Homo sapiens
SGDPASYRLW

SEQ ID NO: 4019 - protein, 10 aa, Homo sapiens
LSRTPTRQIG

SEQ ID NO: 4020 - protein, 10 aa, Homo sapiens
HLFPQEAFPA

SEQ ID NO: 4021 - protein, 10 aa, Homo sapiens
PSRGQALRRA

SEQ ID NO: 4022 - protein, 10 aa, Homo sapiens
AVTPTCATPA

SEQ ID NO: 4023 - protein, 10 aa, Homo sapiens
IGSIDTDPPA

SEQ ID NO: 4024 - protein, 10 aa, Homo sapiens
VLVPEAHPNA

SEQ ID NO: 4025 - protein, 10 aa, Homo sapiens
TTWARRTSRA

SEQ ID NO: 4026 - protein, 10 aa, Homo sapiens
LRHLFPQEAF

SEQ ID NO: 4027 - protein, 10 aa, Homo sapiens
LWGAPLQPTL

SEQ ID NO: 4028 - protein, 10 aa, Homo sapiens
DGPSNPLCCC

SEQ ID NO: 4029 - protein, 10 aa, Homo sapiens
ATPAGPMPCS

SEQ ID NO: 4030 - protein, 10 aa, Homo sapiens
DLSQVWSVVS

SEQ ID NO: 4031 - protein, 10 aa, Homo sapiens
CFHGPAFSTL

SEQ ID NO: 4032 - protein, 10 aa, Homo sapiens
AFPAHPIYDL

SEQ ID NO: 4033 - protein, 10 aa, Homo sapiens
SQVWSVVSPA

SEQ ID NO: 4034 - protein, 10 aa, Homo sapiens
THPAQWEPVL

SEQ ID NO: 4035 - protein, 10 aa, Homo sapiens
CCCFHGPAFS

SEQ ID NO: 4036 - protein, 10 aa, Homo sapiens
CCFHGPAFST

SEQ ID NO: 4037 - protein, 10 aa, Homo sapiens
HPDPPMALSR

SEQ ID NO: 4038 - protein, 10 aa, Homo sapiens
RAVTPTCATP

SEQ ID NO: 4039 - protein, 10 aa, Homo sapiens
CSLHSACCSG

SEQ ID NO: 4040 - protein, 10 aa, Homo sapiens
WSVVSPAPSR

SEQ ID NO: 4041 - protein, 10 aa, Homo sapiens
ASLTMYVCAP

SEQ ID NO: 4042 - protein, 10 aa, Homo sapiens
FSTLNPVLRH

SEQ ID NO: 4043 - protein, 10 aa, Homo sapiens
LSQVWSVVSP

SEQ ID NO: 4044 - protein, 10 aa, Homo sapiens
PSLRCSLHSA

SEQ ID NO: 4045 - protein, 10 aa, Homo sapiens
EAFPAHPIYD

SEQ ID NO: 4046 - protein, 10 aa, Homo sapiens
AHPIYDLSQV

SEQ ID NO: 4047 - protein, 10 aa, Homo sapiens
CAPVPHPDPP

SEQ ID NO: 4048 - protein, 10 aa, Homo sapiens
QASVPLLTHP

SEQ ID NO: 4049 - protein, 10 aa, Homo sapiens
MPCSRLLPSL

SEQ ID NO: 4050 - protein, 10 aa, Homo sapiens
RLLPSLRCSL

SEQ ID NO: 4051 - protein, 10 aa, Homo sapiens
LPSLRCSLHS

SEQ ID NO: 4052 - protein, 10 aa, Homo sapiens
CSRLLPSLRC

SEQ ID NO: 4053 - protein, 10 aa, Homo sapiens
AGPMPCSRLL

SEQ ID NO: 4054 - protein, 10 aa, Homo sapiens
GPMPCSRLLP

SEQ ID NO: 4055 - protein, 10 aa, Homo sapiens
SRLLPSLRCS

SEQ ID NO: 4056 - protein, 10 aa, Homo sapiens
PMPCSRLLPS

SEQ ID NO: 4057 - protein, 10 aa, Homo sapiens
LLPSLRCSLH

SEQ ID NO: 4058 - protein, 10 aa, Homo sapiens
PCSRLLPSLR

SEQ ID NO: 4059 - protein, 10 aa, Homo sapiens
CSGDPASSRL

SEQ ID NO: 4060 - protein, 10 aa, Homo sapiens
ASSRLWGAPL

SEQ ID NO: 4061 - protein, 10 aa, Homo sapiens
DPASSRLWGA

SEQ ID NO: 4062 - protein, 10 aa, Homo sapiens
SSRLWGAPLQ

SEQ ID NO: 4063 - protein, 10 aa, Homo sapiens
ACCSGDPASS

SEQ ID NO: 4064 - protein, 10 aa, Homo sapiens
SGDPASSRLW

SEQ ID NO: 4065 - protein, 10 aa, Homo sapiens
CCSGDPASSR

SEQ ID NO: 4066 - protein, 10 aa, Homo sapiens
PASSRLWGAP

SEQ ID NO: 4067 - protein, 10 aa, Homo sapiens
SRLWGAPLQP

SEQ ID NO: 4068 - protein, 10 aa, Homo sapiens
GDPASSRLWG

SEQ ID NO: 4069 - protein, 10 aa, Homo sapiens
VPLLTDPAQW

SEQ ID NO: 4070 - protein, 10 aa, Homo sapiens
DPAQWEPVLV

SEQ ID NO: 4071 - protein, 10 aa, Homo sapiens
ASVPLLTDPA

SEQ ID NO: 4072 - protein, 10 aa, Homo sapiens
TDPAQWEPVL

SEQ ID NO: 4073 - protein, 10 aa, Homo sapiens
LTDPAQWEPV

SEQ ID NO: 4074 - protein, 10 aa, Homo sapiens
QASVPLLTDP

SEQ ID NO: 4075 - protein, 10 aa, Homo sapiens
LLTDPAQWEP

SEQ ID NO: 4076 - protein, 10 aa, Homo sapiens
SVPLLTDPAQ

SEQ ID NO: 4077 - protein, 10 aa, Homo sapiens
PLLTDPAQWE

SEQ ID NO: 4078 - protein, 10 aa, Homo sapiens
PQASVPLLTD

SEQ ID NO: 4079 - protein, 10 aa, Homo sapiens
VPLLTDLAQW

SEQ ID NO: 4080 - protein, 10 aa, Homo sapiens
QASVPLLTDL

SEQ ID NO: 4081 - protein, 10 aa, Homo sapiens
ASVPLLTDLA

SEQ ID NO: 4082 - protein, 10 aa, Homo sapiens
DLAQWEPVLV

SEQ ID NO: 4083 - protein, 10 aa, Homo sapiens
TDLAQWEPVL

SEQ ID NO: 4084 - protein, 10 aa, Homo sapiens
LTDLAQWEPV

SEQ ID NO: 4085 - protein, 10 aa, Homo sapiens
LLTDLAQWEP

SEQ ID NO: 4086 - protein, 10 aa, Homo sapiens
SVPLLTDLAQ

SEQ ID NO: 4087 - protein, 10 aa, Homo sapiens
PLLTDLAQWE

SEQ ID NO: 4088 - protein, 10 aa, Homo sapiens
VPLLTHLAQW

SEQ ID NO: 4089 - protein, 10 aa, Homo sapiens
QASVPLLTHL

SEQ ID NO: 4090 - protein, 10 aa, Homo sapiens
ASVPLLTHLA

SEQ ID NO: 4091 - protein, 10 aa, Homo sapiens
HLAQWEPVLV

SEQ ID NO: 4092 - protein, 10 aa, Homo sapiens
LTHLAQWEPV

SEQ ID NO: 4093 - protein, 10 aa, Homo sapiens
THLAQWEPVL

SEQ ID NO: 4094 - protein, 10 aa, Homo sapiens
LAQWEPVLVP

SEQ ID NO: 4095 - protein, 10 aa, Homo sapiens
SVPLLTHLAQ

SEQ ID NO: 4096 - protein, 10 aa, Homo sapiens
LLTHLAQWEP

SEQ ID NO: 4097 - protein, 10 aa, Homo sapiens
PLLTHLAQWE

SEQ ID NO: 4098 - protein, 10 aa, Homo sapiens
TPVPHPDPPM

SEQ ID NO: 4099 - protein, 10 aa, Homo sapiens
NASLTMYVCT

SEQ ID NO: 4100 - protein, 10 aa, Homo sapiens
SLTMYVCTPV

SEQ ID NO: 4101 - protein, 10 aa, Homo sapiens
ASLTMYVCTP

SEQ ID NO: 4102 - protein, 10 aa, Homo sapiens
YVCTPVPHPD

SEQ ID NO: 4103 - protein, 10 aa, Homo sapiens
VCTPVPHPDP

SEQ ID NO: 4104 - protein, 10 aa, Homo sapiens
LTMYVCTPVP

SEQ ID NO: 4105 - protein, 10 aa, Homo sapiens
CTPVPHPDPP

SEQ ID NO: 4106 - protein, 10 aa, Homo sapiens
TMYVCTPVPH

SEQ ID NO: 4107 - protein, 10 aa, Homo sapiens
MYVCTPVPHP

SEQ ID NO: 4108 - protein, 10 aa, Homo sapiens
LSRTPTRQIS

SEQ ID NO: 4109 - protein, 10 aa, Homo sapiens
RTPTRQISSI

SEQ ID NO: 4110 - protein, 10 aa, Homo sapiens
ISSIDTDPPA

SEQ ID NO: 4111 - protein, 10 aa, Homo sapiens
TPTRQISSID

SEQ ID NO: 4112 - protein, 10 aa, Homo sapiens
SSIDTDPPAD

SEQ ID NO: 4113 - protein, 10 aa, Homo sapiens
PTRQISSIDT

SEQ ID NO: 4114 - protein, 10 aa, Homo sapiens
RQISSIDTDP

SEQ ID NO: 4115 - protein, 10 aa, Homo sapiens
QISSIDTDPP

SEQ ID NO: 4116 - protein, 10 aa, Homo sapiens
SRTPTRQISS

SEQ ID NO: 4117 - protein, 10 aa, Homo sapiens
TRQISSIDTD

SEQ ID NO: 4118 - protein, 10 aa, Homo sapiens
ISSSDTDPPA

SEQ ID NO: 4119 - protein, 10 aa, Homo sapiens
RTPTRQISSS

SEQ ID NO: 4120 - protein, 10 aa, Homo sapiens
TPTRQISSSD

SEQ ID NO: 4121 - protein, 10 aa, Homo sapiens
SSSDTDPPAD

SEQ ID NO: 4122 - protein, 10 aa, Homo sapiens
PTRQISSSDT

SEQ ID NO: 4123 - protein, 10 aa, Homo sapiens
RQISSSDTDP

SEQ ID NO: 4124 - protein, 10 aa, Homo sapiens
QISSSDTDPP

SEQ ID NO: 4125 - protein, 10 aa, Homo sapiens
TRQISSSDTD

SEQ ID NO: 4126 - protein, 10 aa, Homo sapiens
RTPTRQIGSS

SEQ ID NO: 4127 - protein, 10 aa, Homo sapiens
TPTRQIGSSD

SEQ ID NO: 4128 - protein, 10 aa, Homo sapiens
GSSDTDPPAD

SEQ ID NO: 4129 - protein, 10 aa, Homo sapiens
IGSSDTDPPA

SEQ ID NO: 4130 - protein, 10 aa, Homo sapiens
PTRQIGSSDT

SEQ ID NO: 4131 - protein, 10 aa, Homo sapiens
RQIGSSDTDP

SEQ ID NO: 4132 - protein, 10 aa, Homo sapiens
SSDTDPPADG

SEQ ID NO: 4133 - protein, 10 aa, Homo sapiens
QIGSSDTDPP

SEQ ID NO: 4134 - protein, 10 aa, Homo sapiens
SDTDPPADGP

SEQ ID NO: 4135 - protein, 10 aa, Homo sapiens
TRQIGSSDTD

SEQ ID NO: 4136 - protein, 10 aa, Homo sapiens
PSRGQALRRA

SEQ ID NO: 4137 - protein, 10 aa, Homo sapiens
SRGQALRRAQ

SEQ ID NO: 4138 - protein, 9 aa, Homo sapiens
CVDDSQDYY

SEQ ID NO: 4139 - protein, 9 aa, Homo sapiens
QPGTALLCY

SEQ ID NO: 4140 - protein, 9 aa, Homo sapiens
DTDLCNASG

SEQ ID NO: 4141 - protein, 9 aa, Homo sapiens
SQDYYVGKK

SEQ ID NO: 4142 - protein, 9 aa, Homo sapiens
NCVDDSQDY

SEQ ID NO: 4143 - protein, 9 aa, Homo sapiens
SNEDCLQVE

SEQ ID NO: 4144 - protein, 9 aa, Homo sapiens
VDDSQDYYV

SEQ ID NO: 4145 - protein, 9 aa, Homo sapiens
QVENCTQLG

SEQ ID NO: 4146 - protein, 9 aa, Homo sapiens
DTDPPADGP

SEQ ID NO: 4147 - protein, 9 aa, Homo sapiens
EAFPAHPIY

SEQ ID NO: 4148 - protein, 9 aa, Homo sapiens
HPDPPMALS

SEQ ID NO: 4149 - protein, 9 aa, Homo sapiens
CCSGDPASY

SEQ ID NO: 4150 - protein, 9 aa, Homo sapiens
SGDPASYRL

SEQ ID NO: 4151 - protein, 9 aa, Homo sapiens
QWEPVLVPE

SEQ ID NO: 4152 - protein, 9 aa, Homo sapiens
HPNASLTMY

SEQ ID NO: 4153 - protein, 9 aa, Homo sapiens
STLNPVLRH

SEQ ID NO: 4154 - protein, 9 aa, Homo sapiens
SRLPPSLRC

SEQ ID NO: 4155 - protein, 9 aa, Homo sapiens
PSRGQALRR

SEQ ID NO: 4156 - protein, 9 aa, Homo sapiens
SIDTDPPAD

SEQ ID NO: 4157 - protein, 9 aa, Homo sapiens
PADGPSNPL

SEQ ID NO: 4158 - protein, 9 aa, Homo sapiens
VPEAHPNAS

SEQ ID NO: 4159 - protein, 9 aa, Homo sapiens
PSLRCSLHS

SEQ ID NO: 4160 - protein, 9 aa, Homo sapiens
PTLGVVPQA

SEQ ID NO: 4161 - protein, 9 aa, Homo sapiens
PQASVPLLT

SEQ ID NO: 4162 - protein, 9 aa, Homo sapiens
LTHPAQWEP

SEQ ID NO: 4163 - protein, 9 aa, Homo sapiens
AQWEPVLVP

SEQ ID NO: 4164 - protein, 9 aa, Homo sapiens
PDPPMALSR

SEQ ID NO: 4165 - protein, 9 aa, Homo sapiens
RTPTRQIGS

SEQ ID NO: 4166 - protein, 9 aa, Homo sapiens
PQEAFPAHP

SEQ ID NO: 4167 - protein, 9 aa, Homo sapiens
IYDLSQVWS

SEQ ID NO: 4168 - protein, 9 aa, Homo sapiens
PMPCSRLLP

SEQ ID NO: 4169 - protein, 9 aa, Homo sapiens
SRLLPSLRC

SEQ ID NO: 4170 - protein, 9 aa, Homo sapiens
GPMPCSRLL

SEQ ID NO: 4171 - protein, 9 aa, Homo sapiens
MPCSRLLPS

SEQ ID NO: 4172 - protein, 9 aa, Homo sapiens
CSRLLPSLR

SEQ ID NO: 4173 - protein, 9 aa, Homo sapiens
RLLPSLRCS

SEQ ID NO: 4174 - protein, 9 aa, Homo sapiens
SGDPASSRL

SEQ ID NO: 4175 - protein, 9 aa, Homo sapiens
DPASSRLWG

SEQ ID NO: 4176 - protein, 9 aa, Homo sapiens
SSRLWGAPL

SEQ ID NO: 4177 - protein, 9 aa, Homo sapiens
LTDPAQWEP

SEQ ID NO: 4178 - protein, 9 aa, Homo sapiens
ASVPLLTDP

SEQ ID NO: 4179 - protein, 9 aa, Homo sapiens
LTDLAQWEP

SEQ ID NO: 4180 - protein, 9 aa, Homo sapiens
ASVPLLTDL

SEQ ID NO: 4181 - protein, 9 aa, Homo sapiens
VPLLTDLAQ

SEQ ID NO: 4182 - protein, 9 aa, Homo sapiens
ASVPLLTHL

SEQ ID NO: 4183 - protein, 9 aa, Homo sapiens
VPLLTHLAQ

SEQ ID NO: 4184 - protein, 9 aa, Homo sapiens
LTHLAQWEP

SEQ ID NO: 4185 - protein, 9 aa, Homo sapiens
SVPLLTHLA

SEQ ID NO: 4186 - protein, 9 aa, Homo sapiens
LTMYVCTPV

SEQ ID NO: 4187 - protein, 9 aa, Homo sapiens
VCTPVPHPD

SEQ ID NO: 4188 - protein, 9 aa, Homo sapiens
CTPVPHPDP

SEQ ID NO: 4189 - protein, 9 aa, Homo sapiens
ASLTMYVCT

SEQ ID NO: 4190 - protein, 9 aa, Homo sapiens
SLTMYVCTP

SEQ ID NO: 4191 - protein, 9 aa, Homo sapiens
YVCTPVPHP

SEQ ID NO: 4192 - protein, 9 aa, Homo sapiens
RTPTRQISS

SEQ ID NO: 4193 - protein, 9 aa, Homo sapiens
SRTPTRQIS

SEQ ID NO: 4194 - protein, 9 aa, Homo sapiens
PTRQISSID

SEQ ID NO: 4195 - protein, 9 aa, Homo sapiens
SSIDTDPPA

SEQ ID NO: 4196 - protein, 9 aa, Homo sapiens
TRQISSIDT

SEQ ID NO: 4197 - protein, 9 aa, Homo sapiens
ISSIDTDPP

SEQ ID NO: 4198 - protein, 9 aa, Homo sapiens
PTRQISSSD

SEQ ID NO: 4199 - protein, 9 aa, Homo sapiens
SSSDTDPPA

SEQ ID NO: 4200 - protein, 9 aa, Homo sapiens
ISSSDTDPP

SEQ ID NO: 4201 - protein, 9 aa, Homo sapiens
TPTRQISSS

SEQ ID NO: 4202 - protein, 9 aa, Homo sapiens
SSDTDPPAD

SEQ ID NO: 4203 - protein, 9 aa, Homo sapiens
PTRQIGSSD

SEQ ID NO: 4204 - protein, 9 aa, Homo sapiens
SRGQALRRA

SEQ ID NO: 4205 - protein, 9 aa, Homo sapiens
RGQALRRAQ

SEQ ID NO: 4206 - protein, 9 aa, Homo sapiens
ALQPGTALL

SEQ ID NO: 4207 - protein, 9 aa, Homo sapiens
ALLPALGLL

SEQ ID NO: 4208 - protein, 9 aa, Homo sapiens
AILALLPAL

SEQ ID NO: 4209 - protein, 9 aa, Homo sapiens
LLALLMAGL

SEQ ID NO: 4210 - protein, 9 aa, Homo sapiens
ALLMAGLAL

SEQ ID NO: 4211 - protein, 9 aa, Homo sapiens
ALQPAAAIL

SEQ ID NO: 4212 - protein, 9 aa, Homo sapiens
LLLWGPGQL

SEQ ID NO: 4213 - protein, 9 aa, Homo sapiens
LLPALGLLL

SEQ ID NO: 4214 - protein, 9 aa, Homo sapiens
IRAVGLLTV

SEQ ID NO: 4215 - protein, 9 aa, Homo sapiens
LLMAGLALQ

SEQ ID NO: 4216 - protein, 9 aa, Homo sapiens
ALLCYSCKA

SEQ ID NO: 4217 - protein, 9 aa, Homo sapiens
LALLPALGL

SEQ ID NO: 4218 - protein, 9 aa, Homo sapiens
LALQPGTAL

SEQ ID NO: 4219 - protein, 9 aa, Homo sapiens
MKAVLLALL

SEQ ID NO: 4220 - protein, 9 aa, Homo sapiens
VLLALLMAG

SEQ ID NO: 4221 - protein, 9 aa, Homo sapiens
GLALQPGTA

SEQ ID NO: 4222 - protein, 9 aa, Homo sapiens
RAVGLLTVI

SEQ ID NO: 4223 - protein, 9 aa, Homo sapiens
GLLTVISKG

SEQ ID NO: 4224 - protein, 9 aa, Homo sapiens
TVISKGCSL

SEQ ID NO: 4225 - protein, 9 aa, Homo sapiens
PAAAILALL

SEQ ID NO: 4226 - protein, 9 aa, Homo sapiens
QLGEQCWTA

SEQ ID NO: 4227 - protein, 9 aa, Homo sapiens
ARIRAVGLL

SEQ ID NO: 4228 - protein, 9 aa, Homo sapiens
HALQPAAAI

SEQ ID NO: 4229 - protein, 9 aa, Homo sapiens
QPAAAILAL

SEQ ID NO: 4230 - protein, 9 aa, Homo sapiens
ALGLLLWGP

SEQ ID NO: 4231 - protein, 9 aa, Homo sapiens
AVLLALLMA

SEQ ID NO: 4232 - protein, 9 aa, Homo sapiens
TARIRAVGL

SEQ ID NO: 4233 - protein, 9 aa, Homo sapiens
SKGCSLNCV

SEQ ID NO: 4234 - protein, 9 aa, Homo sapiens
NITCCDTDL

SEQ ID NO: 4235 - protein, 9 aa, Homo sapiens
AAILALLPA

SEQ ID NO: 4236 - protein, 9 aa, Homo sapiens
ILALLPALG

SEQ ID NO: 4237 - protein, 9 aa, Homo sapiens
LMAGLALQP

SEQ ID NO: 4238 - protein, 9 aa, Homo sapiens
CNASGAHAL

SEQ ID NO: 4239 - protein, 9 aa, Homo sapiens
LCYSCKAQV

SEQ ID NO: 4240 - protein, 9 aa, Homo sapiens
VSNEDCLQV

SEQ ID NO: 4241 - protein, 9 aa, Homo sapiens
SLNCVDDSQ

SEQ ID NO: 4242 - protein, 9 aa, Homo sapiens
GLLLWGPGQ

SEQ ID NO: 4243 - protein, 9 aa, Homo sapiens
LQVENCTQL

SEQ ID NO: 4244 - protein, 9 aa, Homo sapiens
CWTARIRAV

SEQ ID NO: 4245 - protein, 9 aa, Homo sapiens
SGDPASYRL

SEQ ID NO: 4246 - protein, 9 aa, Homo sapiens
PADGPSNPL

SEQ ID NO: 4247 - protein, 9 aa, Homo sapiens
FHGPAFSTL

SEQ ID NO: 4248 - protein, 9 aa, Homo sapiens
HLFPQEAFP

SEQ ID NO: 4249 - protein, 9 aa, Homo sapiens
HPIYDLSQV

SEQ ID NO: 4250 - protein, 9 aa, Homo sapiens
SLHSACCSG

SEQ ID NO: 4251 - protein, 9 aa, Homo sapiens
SYRLWGAPL

SEQ ID NO: 4252 - protein, 9 aa, Homo sapiens
RLWGAPLQP

SEQ ID NO: 4253 - protein, 9 aa, Homo sapiens
PTLGVVPQA

SEQ ID NO: 4254 - protein, 9 aa, Homo sapiens
SVPLLTHPA

SEQ ID NO: 4255 - protein, 9 aa, Homo sapiens
VLVPEAHPN

SEQ ID NO: 4256 - protein, 9 aa, Homo sapiens
PEAHPNASL

SEQ ID NO: 4257 - protein, 9 aa, Homo sapiens
AFSTLNPVL

SEQ ID NO: 4258 - protein, 9 aa, Homo sapiens
STLNPVLRH

SEQ ID NO: 4259 - protein, 9 aa, Homo sapiens
AGPMPCSRL

SEQ ID NO: 4260 - protein, 9 aa, Homo sapiens
HPAQWEPVL

SEQ ID NO: 4261 - protein, 9 aa, Homo sapiens
PAQWEPVLV

SEQ ID NO: 4262 - protein, 9 aa, Homo sapiens
LVPEAHPNA

SEQ ID NO: 4263 - protein, 9 aa, Homo sapiens
LSRTPTRQI

SEQ ID NO: 4264 - protein, 9 aa, Homo sapiens
TPTRQIGSI

SEQ ID NO: 4265 - protein, 9 aa, Homo sapiens
VLRHLFPQE

SEQ ID NO: 4266 - protein, 9 aa, Homo sapiens
QVWSVVSPA

SEQ ID NO: 4267 - protein, 9 aa, Homo sapiens
TLNPVLRHL

SEQ ID NO: 4268 - protein, 9 aa, Homo sapiens
SLRCSLHSA

SEQ ID NO: 4269 - protein, 9 aa, Homo sapiens
PLQPTLGVV

SEQ ID NO: 4270 - protein, 9 aa, Homo sapiens
YDLSQVWSV

SEQ ID NO: 4271 - protein, 9 aa, Homo sapiens
APLQPTLGV

SEQ ID NO: 4272 - protein, 9 aa, Homo sapiens
FPAHPIYDL

SEQ ID NO: 4273 - protein, 9 aa, Homo sapiens
DLSQVWSVV

SEQ ID NO: 4274 - protein, 9 aa, Homo sapiens
WGAPLQPTL

SEQ ID NO: 4275 - protein, 9 aa, Homo sapiens
LTMYVCAPV

SEQ ID NO: 4276 - protein, 9 aa, Homo sapiens
LGVVPQASV

SEQ ID NO: 4277 - protein, 9 aa, Homo sapiens
VVPQASVPL

SEQ ID NO: 4278 - protein, 9 aa, Homo sapiens
SLTMYVCAP

SEQ ID NO: 4279 - protein, 9 aa, Homo sapiens
PAFSTLNPV

SEQ ID NO: 4280 - protein, 9 aa, Homo sapiens
RLPPSLRCS

SEQ ID NO: 4281 - protein, 9 aa, Homo sapiens
VPQASVPLL

SEQ ID NO: 4282 - protein, 9 aa, Homo sapiens
WARRTSRAV

SEQ ID NO: 4283 - protein, 9 aa, Homo sapiens
LPPSLRCSL

SEQ ID NO: 4284 - protein, 9 aa, Homo sapiens
SGDPASYRL

SEQ ID NO: 4285 - protein, 9 aa, Homo sapiens
PADGPSNPL

SEQ ID NO: 4286 - protein, 9 aa, Homo sapiens
FHGPAFSTL

SEQ ID NO: 4287 - protein, 9 aa, Homo sapiens
HLFPQEAFP

SEQ ID NO: 4288 - protein, 9 aa, Homo sapiens
HPIYDLSQV

SEQ ID NO: 4289 - protein, 9 aa, Homo sapiens
SLHSACCSG

SEQ ID NO: 4290 - protein, 9 aa, Homo sapiens
SYRLWGAPL

SEQ ID NO: 4291 - protein, 9 aa, Homo sapiens
RLWGAPLQP

SEQ ID NO: 4292 - protein, 9 aa, Homo sapiens
PTLGVVPQA

SEQ ID NO: 4293 - protein, 9 aa, Homo sapiens
SVPLLTHPA

SEQ ID NO: 4294 - protein, 9 aa, Homo sapiens
VLVPEAHPN

SEQ ID NO: 4295 - protein, 9 aa, Homo sapiens
PEAHPNASL

SEQ ID NO: 4296 - protein, 9 aa, Homo sapiens
AFSTLNPVL

SEQ ID NO: 4297 - protein, 9 aa, Homo sapiens
STLNPVLRH

SEQ ID NO: 4298 - protein, 9 aa, Homo sapiens
AGPMPCSRL

SEQ ID NO: 4299 - protein, 9 aa, Homo sapiens
HPAQWEPVL

SEQ ID NO: 4300 - protein, 9 aa, Homo sapiens
PAQWEPVLV

SEQ ID NO: 4301 - protein, 9 aa, Homo sapiens
LVPEAHPNA

SEQ ID NO: 4302 - protein, 9 aa, Homo sapiens
LSRTPTRQI

SEQ ID NO: 4303 - protein, 9 aa, Homo sapiens
TPTRQIGSI

SEQ ID NO: 4304 - protein, 9 aa, Homo sapiens
VLRHLFPQE

SEQ ID NO: 4305 - protein, 9 aa, Homo sapiens
QVWSVVSPA

SEQ ID NO: 4306 - protein, 9 aa, Homo sapiens
LLPSLRCSL

SEQ ID NO: 4307 - protein, 9 aa, Homo sapiens
RLLPSLRCS

SEQ ID NO: 4308 - protein, 9 aa, Homo sapiens
PCSRLLPSL

SEQ ID NO: 4309 - protein, 9 aa, Homo sapiens
GPMPCSRLL

SEQ ID NO: 4310 - protein, 9 aa, Homo sapiens
SGDPASSRL

SEQ ID NO: 4311 - protein, 9 aa, Homo sapiens
SSRLWGAPL

SEQ ID NO: 4312 - protein, 9 aa, Homo sapiens
PASSRLWGA

SEQ ID NO: 4313 - protein, 9 aa, Homo sapiens
SRLWGAPLQ

SEQ ID NO: 4314 - protein, 9 aa, Homo sapiens
CCSGDPASS

SEQ ID NO: 4315 - protein, 9 aa, Homo sapiens
SVPLLTDPA

SEQ ID NO: 4316 - protein, 9 aa, Homo sapiens
LLTDPAQWE

SEQ ID NO: 4317 - protein, 9 aa, Homo sapiens
QASVPLLTD

SEQ ID NO: 4318 - protein, 9 aa, Homo sapiens
DPAQWEPVL

SEQ ID NO: 4319 - protein, 9 aa, Homo sapiens
PLLTDPAQW

SEQ ID NO: 4320 - protein, 9 aa, Homo sapiens
LTDPAQWEP

SEQ ID NO: 4321 - protein, 9 aa, Homo sapiens
TDPAQWEPV

SEQ ID NO: 4322 - protein, 9 aa, Homo sapiens
ASVPLLTDP

SEQ ID NO: 4323 - protein, 9 aa, Homo sapiens
DLAQWEPVL

SEQ ID NO: 4324 - protein, 9 aa, Homo sapiens
ASVPLLTDL

SEQ ID NO: 4325 - protein, 9 aa, Homo sapiens
PLLTDLAQW

SEQ ID NO: 4326 - protein, 9 aa, Homo sapiens
SVPLLTDLA

SEQ ID NO: 4327 - protein, 9 aa, Homo sapiens
LLTDLAQWE

SEQ ID NO: 4328 - protein, 9 aa, Homo sapiens
TDLAQWEPV

SEQ ID NO: 4329 - protein, 9 aa, Homo sapiens
HLAQWEPVL

SEQ ID NO: 4330 - protein, 9 aa, Homo sapiens
ASVPLLTHL

SEQ ID NO: 4331 - protein, 9 aa, Homo sapiens
LAQWEPVLV

SEQ ID NO: 4332 - protein, 9 aa, Homo sapiens
PLLTHLAQW

SEQ ID NO: 4333 - protein, 9 aa, Homo sapiens
SVPLLTHLA

SEQ ID NO: 4334 - protein, 9 aa, Homo sapiens
LLTHLAQWE

SEQ ID NO: 4335 - protein, 9 aa, Homo sapiens
THLAQWEPV

SEQ ID NO: 4336 - protein, 9 aa, Homo sapiens
SLTMYVCTP

SEQ ID NO: 4337 - protein, 9 aa, Homo sapiens
LTMYVCTPV

SEQ ID NO: 4338 - protein, 9 aa, Homo sapiens
TMYVCTPVP

SEQ ID NO: 4339 - protein, 9 aa, Homo sapiens
YVCTPVPHP

SEQ ID NO: 4340 - protein, 9 aa, Homo sapiens
ASLTMYVCT

SEQ ID NO: 4341 - protein, 9 aa, Homo sapiens
TPTRQISSI

SEQ ID NO: 4342 - protein, 9 aa, Homo sapiens
SSIDTDPPA

SEQ ID NO: 4343 - protein, 9 aa, Homo sapiens
RQISSIDTD

SEQ ID NO: 4344 - protein, 9 aa, Homo sapiens
QISSIDTDP

SEQ ID NO: 4345 - protein, 9 aa, Homo sapiens
RTPTRQISS

SEQ ID NO: 4346 - protein, 9 aa, Homo sapiens
QISSSDTDP

SEQ ID NO: 4347 - protein, 9 aa, Homo sapiens
SSSDTDPPA

SEQ ID NO: 4348 - protein, 9 aa, Homo sapiens
TPTRQISSS

SEQ ID NO: 4349 - protein, 9 aa, Homo sapiens
TRQISSSDT

SEQ ID NO: 4350 - protein, 9 aa, Homo sapiens
RQISSSDTD

SEQ ID NO: 4351 - protein, 9 aa, Homo sapiens
ISSSDTDPP

SEQ ID NO: 4352 - protein, 9 aa, Homo sapiens
PTRQISSSD

SEQ ID NO: 4353 - protein, 9 aa, Homo sapiens
QIGSSDTDP

SEQ ID NO: 4354 - protein, 9 aa, Homo sapiens
GSSDTDPPA

SEQ ID NO: 4355 - protein, 9 aa, Homo sapiens
TRQIGSSDT

SEQ ID NO: 4356 - protein, 9 aa, Homo sapiens
RQIGSSDTD

SEQ ID NO: 4357 - protein, 9 aa, Homo sapiens
TPTRQIGSS

SEQ ID NO: 4358 - protein, 9 aa, Homo sapiens
SDTDPPADG

SEQ ID NO: 4359 - protein, 9 aa, Homo sapiens
IGSSDTDPP

SEQ ID NO: 4360 - protein, 9 aa, Homo sapiens
SSDTDPPAD

SEQ ID NO: 4361 - protein, 9 aa, Homo sapiens
PTRQIGSSD

SEQ ID NO: 4362 - protein, 9 aa, Homo sapiens
SRGQALRRA

SEQ ID NO: 4363 - protein, 9 aa, Homo sapiens
RIRAVGLLT

SEQ ID NO: 4364 - protein, 9 aa, Homo sapiens
ALLMAGLAL

SEQ ID NO: 4365 - protein, 9 aa, Homo sapiens
ALQPAAAIL

SEQ ID NO: 4366 - protein, 9 aa, Homo sapiens
ALQPGTALL

SEQ ID NO: 4367 - protein, 9 aa, Homo sapiens
AVLLALLMA

SEQ ID NO: 4368 - protein, 9 aa, Homo sapiens
TVISKGCSL

SEQ ID NO: 4369 - protein, 9 aa, Homo sapiens
ALLPALGLL

SEQ ID NO: 4370 - protein, 9 aa, Homo sapiens
LLLWGPGQL

SEQ ID NO: 4371 - protein, 9 aa, Homo sapiens
GLALQPGTA

SEQ ID NO: 4372 - protein, 9 aa, Homo sapiens
AVGLLTVIS

SEQ ID NO: 4373 - protein, 9 aa, Homo sapiens
ILALLPALG

SEQ ID NO: 4374 - protein, 9 aa, Homo sapiens
LLPALGLLL

SEQ ID NO: 4375 - protein, 9 aa, Homo sapiens
LLMAGLALQ

SEQ ID NO: 4376 - protein, 9 aa, Homo sapiens
QLGEQCWTA

SEQ ID NO: 4377 - protein, 9 aa, Homo sapiens
CVDDSQDYY

SEQ ID NO: 4378 - protein, 9 aa, Homo sapiens
DLCNASGAH

SEQ ID NO: 4379 - protein, 9 aa, Homo sapiens
VLLALLMAG

SEQ ID NO: 4380 - protein, 9 aa, Homo sapiens
TALLCYSCK

SEQ ID NO: 4381 - protein, 9 aa, Homo sapiens
GLLTVISKG

SEQ ID NO: 4382 - protein, 9 aa, Homo sapiens
AILALLPAL

SEQ ID NO: 4383 - protein, 9 aa, Homo sapiens
GLLLWGPGQ

SEQ ID NO: 4384 - protein, 9 aa, Homo sapiens
LLALLMAGL

SEQ ID NO: 4385 - protein, 9 aa, Homo sapiens
ALLCYSCKA

SEQ ID NO: 4386 - protein, 9 aa, Homo sapiens
VGLLTVISK

SEQ ID NO: 4387 - protein, 9 aa, Homo sapiens
DSQDYYVGK

SEQ ID NO: 4388 - protein, 9 aa, Homo sapiens
YVGKKNITC

SEQ ID NO: 4389 - protein, 9 aa, Homo sapiens
CLQVENCTQ

SEQ ID NO: 4390 - protein, 9 aa, Homo sapiens
SLNCVDDSQ

SEQ ID NO: 4391 - protein, 9 aa, Homo sapiens
ASGAHALQP

SEQ ID NO: 4392 - protein, 9 aa, Homo sapiens
ALGLLLWGP

SEQ ID NO: 4393 - protein, 9 aa, Homo sapiens
QVSNEDCLQ

SEQ ID NO: 4394 - protein, 9 aa, Homo sapiens
QVENCTQLG

SEQ ID NO: 4395 - protein, 9 aa, Homo sapiens
TARIRAVGL

SEQ ID NO: 4396 - protein, 9 aa, Homo sapiens
VISKGCSLN

SEQ ID NO: 4397 - protein, 9 aa, Homo sapiens
LMAGLALQP

SEQ ID NO: 4398 - protein, 9 aa, Homo sapiens
WTARIRAVG

SEQ ID NO: 4399 - protein, 9 aa, Homo sapiens
IRAVGLLTV

SEQ ID NO: 4400 - protein, 9 aa, Homo sapiens
SQDYYVGKK

SEQ ID NO: 4401 - protein, 9 aa, Homo sapiens
QPGTALLCY

SEQ ID NO: 4402 - protein, 9 aa, Homo sapiens
LLCYSCKAQ

SEQ ID NO: 4403 - protein, 9 aa, Homo sapiens
RAVGLLTVI

SEQ ID NO: 4404 - protein, 9 aa, Homo sapiens
AAAILALLP

SEQ ID NO: 4405 - protein, 9 aa, Homo sapiens
AVTPTCATP

SEQ ID NO: 4406 - protein, 9 aa, Homo sapiens
RLWGAPLQP

SEQ ID NO: 4407 - protein, 9 aa, Homo sapiens
GVVPQASVP

SEQ ID NO: 4408 - protein, 9 aa, Homo sapiens
SVVSPAPSR

SEQ ID NO: 4409 - protein, 9 aa, Homo sapiens
PLLTHPAQW

SEQ ID NO: 4410 - protein, 9 aa, Homo sapiens
PLQPTLGVV

SEQ ID NO: 4411 - protein, 9 aa, Homo sapiens
ALSRTPTRQ

SEQ ID NO: 4412 - protein, 9 aa, Homo sapiens
DLSQVWSVV

SEQ ID NO: 4413 - protein, 9 aa, Homo sapiens
RRTSRAVTP

SEQ ID NO: 4414 - protein, 9 aa, Homo sapiens
RLPPSLRCS

SEQ ID NO: 4415 - protein, 9 aa, Homo sapiens
PIYDLSQVW

SEQ ID NO: 4416 - protein, 9 aa, Homo sapiens
VVSPAPSRG

SEQ ID NO: 4417 - protein, 9 aa, Homo sapiens
SLRCSLHSA

SEQ ID NO: 4418 - protein, 9 aa, Homo sapiens
VLVPEAHPN

SEQ ID NO: 4419 - protein, 9 aa, Homo sapiens
VLRHLFPQE

SEQ ID NO: 4420 - protein, 9 aa, Homo sapiens
HLFPQEAFP

SEQ ID NO: 4421 - protein, 9 aa, Homo sapiens
QVWSVVSPA

SEQ ID NO: 4422 - protein, 9 aa, Homo sapiens
PVLVPEAHP

SEQ ID NO: 4423 - protein, 9 aa, Homo sapiens
PDPPMALSR

SEQ ID NO: 4424 - protein, 9 aa, Homo sapiens
PVLRHLFPQ

SEQ ID NO: 4425 - protein, 9 aa, Homo sapiens
APSRGQALR

SEQ ID NO: 4426 - protein, 9 aa, Homo sapiens
PSRGQALRR

SEQ ID NO: 4427 - protein, 9 aa, Homo sapiens
ARRTSRAVT

SEQ ID NO: 4428 - protein, 9 aa, Homo sapiens
CCSGDPASY

SEQ ID NO: 4429 - protein, 9 aa, Homo sapiens
VVPQASVPL

SEQ ID NO: 4430 - protein, 9 aa, Homo sapiens
LLTHPAQWE

SEQ ID NO: 4431 - protein, 9 aa, Homo sapiens
TLNPVLRHL

SEQ ID NO: 4432 - protein, 9 aa, Homo sapiens
SLHSACCSG

SEQ ID NO: 4433 - protein, 9 aa, Homo sapiens
TLGVVPQAS

SEQ ID NO: 4434 - protein, 9 aa, Homo sapiens
QASVPLLTH

SEQ ID NO: 4435 - protein, 9 aa, Homo sapiens
RQIGSIDTD

SEQ ID NO: 4436 - protein, 9 aa, Homo sapiens
TTWARRTSR

SEQ ID NO: 4437 - protein, 9 aa, Homo sapiens
CSRLPPSLR

SEQ ID NO: 4438 - protein, 9 aa, Homo sapiens
ASYRLWGAP

SEQ ID NO: 4439 - protein, 9 aa, Homo sapiens
SVPLLTHPA

SEQ ID NO: 4440 - protein, 9 aa, Homo sapiens
SLTMYVCAP

SEQ ID NO: 4441 - protein, 9 aa, Homo sapiens
YVCAPVPHP

SEQ ID NO: 4442 - protein, 9 aa, Homo sapiens
MALSRTPTR

SEQ ID NO: 4443 - protein, 9 aa, Homo sapiens
RGQALRRAR

SEQ ID NO: 4444 - protein, 9 aa, Homo sapiens
CSGDPASYR

SEQ ID NO: 4445 - protein, 9 aa, Homo sapiens
SYRLWGAPL

SEQ ID NO: 4446 - protein, 9 aa, Homo sapiens
LQPTLGVVP

SEQ ID NO: 4447 - protein, 9 aa, Homo sapiens
AQWEPVLVP

SEQ ID NO: 4448 - protein, 9 aa, Homo sapiens
LVPEAHPNA

SEQ ID NO: 4449 - protein, 9 aa, Homo sapiens
AHPNASLTM

SEQ ID NO: 4450 - protein, 9 aa, Homo sapiens
TMYVCAPVP

SEQ ID NO: 4451 - protein, 9 aa, Homo sapiens
QIGSIDTDP

SEQ ID NO: 4452 - protein, 9 aa, Homo sapiens
SIDTDPPAD

SEQ ID NO: 4453 - protein, 9 aa, Homo sapiens
STLNPVLRH

SEQ ID NO: 4454 - protein, 9 aa, Homo sapiens
RHLFPQEAF

SEQ ID NO: 4455 - protein, 9 aa, Homo sapiens
RLLPSLRCS

SEQ ID NO: 4456 - protein, 9 aa, Homo sapiens
LLPSLRCSL

SEQ ID NO: 4457 - protein, 9 aa, Homo sapiens
CSRLLPSLR

SEQ ID NO: 4458 - protein, 9 aa, Homo sapiens
LPSLRCSLH

SEQ ID NO: 4459 - protein, 9 aa, Homo sapiens
CSGDPASSR

SEQ ID NO: 4460 - protein, 9 aa, Homo sapiens
SSRLWGAPL

SEQ ID NO: 4461 - protein, 9 aa, Homo sapiens
CCSGDPASS

SEQ ID NO: 4462 - protein, 9 aa, Homo sapiens
ASSRLWGAP

SEQ ID NO: 4463 - protein, 9 aa, Homo sapiens
SRLWGAPLQ

SEQ ID NO: 4464 - protein, 9 aa, Homo sapiens
SGDPASSRL

SEQ ID NO: 4465 - protein, 9 aa, Homo sapiens
DPASSRLWG

SEQ ID NO: 4466 - protein, 9 aa, Homo sapiens
PLLTDPAQW

SEQ ID NO: 4467 - protein, 9 aa, Homo sapiens
LLTDPAQWE

SEQ ID NO: 4468 - protein, 9 aa, Homo sapiens
SVPLLTDPA

SEQ ID NO: 4469 - protein, 9 aa, Homo sapiens
QASVPLLTD

SEQ ID NO: 4470 - protein, 9 aa, Homo sapiens
PLLTDLAQW

SEQ ID NO: 4471 - protein, 9 aa, Homo sapiens
LLTDLAQWE

SEQ ID NO: 4472 - protein, 9 aa, Homo sapiens
DLAQWEPVL

SEQ ID NO: 4473 - protein, 9 aa, Homo sapiens
SVPLLTDLA

SEQ ID NO: 4474 - protein, 9 aa, Homo sapiens
PLLTHLAQW

SEQ ID NO: 4475 - protein, 9 aa, Homo sapiens
HLAQWEPVL

SEQ ID NO: 4476 - protein, 9 aa, Homo sapiens
LLTHLAQWE

SEQ ID NO: 4477 - protein, 9 aa, Homo sapiens
SVPLLTHLA

SEQ ID NO: 4478 - protein, 9 aa, Homo sapiens
SLTMYVCTP

SEQ ID NO: 4479 - protein, 9 aa, Homo sapiens
YVCTPVPHP

SEQ ID NO: 4480 - protein, 9 aa, Homo sapiens
ASLTMYVCT

SEQ ID NO: 4481 - protein, 9 aa, Homo sapiens
MYVCTPVPH

SEQ ID NO: 4482 - protein, 9 aa, Homo sapiens
TMYVCTPVP

SEQ ID NO: 4483 - protein, 9 aa, Homo sapiens
RQISSIDTD

SEQ ID NO: 4484 - protein, 9 aa, Homo sapiens
QISSIDTDP

SEQ ID NO: 4485 - protein, 9 aa, Homo sapiens
RTPTRQISS

SEQ ID NO: 4486 - protein, 9 aa, Homo sapiens
TPTRQISSI

SEQ ID NO: 4487 - protein, 9 aa, Homo sapiens
PTRQISSID

SEQ ID NO: 4488 - protein, 9 aa, Homo sapiens
SRTPTRQIS

SEQ ID NO: 4489 - protein, 9 aa, Homo sapiens
SSIDTDPPA

SEQ ID NO: 4490 - protein, 9 aa, Homo sapiens
RQISSSDTD

SEQ ID NO: 4491 - protein, 9 aa, Homo sapiens
QISSSDTDP

SEQ ID NO: 4492 - protein, 9 aa, Homo sapiens
TPTRQISSS

SEQ ID NO: 4493 - protein, 9 aa, Homo sapiens
PTRQISSSD

SEQ ID NO: 4494 - protein, 9 aa, Homo sapiens
RQIGSSDTD

SEQ ID NO: 4495 - protein, 9 aa, Homo sapiens
PTRQIGSSD

SEQ ID NO: 4496 - protein, 9 aa, Homo sapiens
QIGSSDTDP

SEQ ID NO: 4497 - protein, 9 aa, Homo sapiens
TPTRQIGSS

SEQ ID NO: 4498 - protein, 9 aa, Homo sapiens
TRQIGSSDT

SEQ ID NO: 4499 - protein, 9 aa, Homo sapiens
SDTDPPADG

SEQ ID NO: 4500 - protein, 9 aa, Homo sapiens
RGQALRRAQ

SEQ ID NO: 4501 - protein, 9 aa, Homo sapiens
TVISKGCSL

SEQ ID NO: 4502 - protein, 9 aa, Homo sapiens
CVDDSQDYY

SEQ ID NO: 4503 - protein, 9 aa, Homo sapiens
AILALLPAL

SEQ ID NO: 4504 - protein, 9 aa, Homo sapiens
ARIRAVGLL

SEQ ID NO: 4505 - protein, 9 aa, Homo sapiens
DTDLCNASG

SEQ ID NO: 4506 - protein, 9 aa, Homo sapiens
AVLLALLMA

SEQ ID NO: 4507 - protein, 9 aa, Homo sapiens
LQVENCTQL

SEQ ID NO: 4508 - protein, 9 aa, Homo sapiens
QPGTALLCY

SEQ ID NO: 4509 - protein, 9 aa, Homo sapiens
ENCTQLGEQ

SEQ ID NO: 4510 - protein, 9 aa, Homo sapiens
NCVDDSQDY

SEQ ID NO: 4511 - protein, 9 aa, Homo sapiens
AQVSNEDCL

SEQ ID NO: 4512 - protein, 9 aa, Homo sapiens
EDCLQVENC

SEQ ID NO: 4513 - protein, 9 aa, Homo sapiens
QPAAAILAL

SEQ ID NO: 4514 - protein, 9 aa, Homo sapiens
PAAAILALL

SEQ ID NO: 4515 - protein, 9 aa, Homo sapiens
ALLPALGLL

SEQ ID NO: 4516 - protein, 9 aa, Homo sapiens
MKAVLLALL

SEQ ID NO: 4517 - protein, 9 aa, Homo sapiens
LTVISKGCS

SEQ ID NO: 4518 - protein, 9 aa, Homo sapiens
YVGKKNITC

SEQ ID NO: 4519 - protein, 9 aa, Homo sapiens
NITCCDTDL

SEQ ID NO: 4520 - protein, 9 aa, Homo sapiens
EAFPAHPIY

SEQ ID NO: 4521 - protein, 9 aa, Homo sapiens
VVPQASVPL

SEQ ID NO: 4522 - protein, 9 aa, Homo sapiens
DTDPPADGP

SEQ ID NO: 4523 - protein, 9 aa, Homo sapiens
SVVSPAPSR

SEQ ID NO: 4524 - protein, 9 aa, Homo sapiens
GVVPQASVP

SEQ ID NO: 4525 - protein, 9 aa, Homo sapiens
QVWSVVSPA

SEQ ID NO: 4526 - protein, 9 aa, Homo sapiens
EPVLVPEAH

SEQ ID NO: 4527 - protein, 9 aa, Homo sapiens
HPNASLTMY

SEQ ID NO: 4528 - protein, 9 aa, Homo sapiens
YVCAPVPHP

SEQ ID NO: 4529 - protein, 9 aa, Homo sapiens
STLNPVLRH

SEQ ID NO: 4530 - protein, 9 aa, Homo sapiens
TLNPVLRHL

SEQ ID NO: 4531 - protein, 9 aa, Homo sapiens
PVLRHLFPQ

SEQ ID NO: 4532 - protein, 9 aa, Homo sapiens
AVTPTCATP

SEQ ID NO: 4533 - protein, 9 aa, Homo sapiens
PTLGVVPQA

SEQ ID NO: 4534 - protein, 9 aa, Homo sapiens
EAHPNASLT

SEQ ID NO: 4535 - protein, 9 aa, Homo sapiens
DPPMALSRT

SEQ ID NO: 4536 - protein, 9 aa, Homo sapiens
RTSRAVTPT

SEQ ID NO: 4537 - protein, 9 aa, Homo sapiens
VPQASVPLL

SEQ ID NO: 4538 - protein, 9 aa, Homo sapiens
SVPLLTHPA

SEQ ID NO: 4539 - protein, 9 aa, Homo sapiens
LVPEAHPNA

SEQ ID NO: 4540 - protein, 9 aa, Homo sapiens
PTRQIGSID

SEQ ID NO: 4541 - protein, 9 aa, Homo sapiens
FPAHPIYDL

SEQ ID NO: 4542 - protein, 9 aa, Homo sapiens
VVSPAPSRG

SEQ ID NO: 4543 - protein, 9 aa, Homo sapiens
PCSRLLPSL

SEQ ID NO: 4544 - protein, 9 aa, Homo sapiens
LLPSLRCSL

SEQ ID NO: 4545 - protein, 9 aa, Homo sapiens
GPMPCSRLL

SEQ ID NO: 4546 - protein, 9 aa, Homo sapiens
MPCSRLLPS

SEQ ID NO: 4547 - protein, 9 aa, Homo sapiens
SGDPASSRL

SEQ ID NO: 4548 - protein, 9 aa, Homo sapiens
DPASSRLWG

SEQ ID NO: 4549 - protein, 9 aa, Homo sapiens
SSRLWGAPL

SEQ ID NO: 4550 - protein, 9 aa, Homo sapiens
PASSRLWGA

SEQ ID NO: 4551 - protein, 9 aa, Homo sapiens
DPAQWEPVL

SEQ ID NO: 4552 - protein, 9 aa, Homo sapiens
SVPLLTDPA

SEQ ID NO: 4553 - protein, 9 aa, Homo sapiens
ASVPLLTDP

SEQ ID NO: 4554 - protein, 9 aa, Homo sapiens
LTDPAQWEP

SEQ ID NO: 4555 - protein, 9 aa, Homo sapiens
ASVPLLTDL

SEQ ID NO: 4556 - protein, 9 aa, Homo sapiens
DLAQWEPVL

SEQ ID NO: 4557 - protein, 9 aa, Homo sapiens
SVPLLTDLA

SEQ ID NO: 4558 - protein, 9 aa, Homo sapiens
LTDLAQWEP

SEQ ID NO: 4559 - protein, 9 aa, Homo sapiens
ASVPLLTHL

SEQ ID NO: 4560 - protein, 9 aa, Homo sapiens
SVPLLTHLA

SEQ ID NO: 4561 - protein, 9 aa, Homo sapiens
LTHLAQWEP

SEQ ID NO: 4562 - protein, 9 aa, Homo sapiens
HLAQWEPVL

SEQ ID NO: 4563 - protein, 9 aa, Homo sapiens
YVCTPVPHP

SEQ ID NO: 4564 - protein, 9 aa, Homo sapiens
LTMYVCTPV

SEQ ID NO: 4565 - protein, 9 aa, Homo sapiens
CTPVPHPDP

SEQ ID NO: 4566 - protein, 9 aa, Homo sapiens
SLTMYVCTP

SEQ ID NO: 4567 - protein, 9 aa, Homo sapiens
PTRQISSID

SEQ ID NO: 4568 - protein, 9 aa, Homo sapiens
RTPTRQISS

SEQ ID NO: 4569 - protein, 9 aa, Homo sapiens
RQISSIDTD

SEQ ID NO: 4570 - protein, 9 aa, Homo sapiens
TPTRQISSI

SEQ ID NO: 4571 - protein, 9 aa, Homo sapiens
QISSIDTDP

SEQ ID NO: 4572 - protein, 9 aa, Homo sapiens
SSIDTDPPA

SEQ ID NO: 4573 - protein, 9 aa, Homo sapiens
PTRQISSSD

SEQ ID NO: 4574 - protein, 9 aa, Homo sapiens
TPTRQISSS

SEQ ID NO: 4575 - protein, 9 aa, Homo sapiens
RQISSSDTD

SEQ ID NO: 4576 - protein, 9 aa, Homo sapiens
QISSSDTDP

SEQ ID NO: 4577 - protein, 9 aa, Homo sapiens
PTRQIGSSD

SEQ ID NO: 4578 - protein, 9 aa, Homo sapiens
TPTRQIGSS

SEQ ID NO: 4579 - protein, 9 aa, Homo sapiens
SRGQALRRA

SEQ ID NO: 4580 - protein, 9 aa, Homo sapiens
QPAAAILAL

SEQ ID NO: 4581 - protein, 9 aa, Homo sapiens
ALLMAGLAL

SEQ ID NO: 4582 - protein, 9 aa, Homo sapiens
LALQPGTAL

SEQ ID NO: 4583 - protein, 9 aa, Homo sapiens
ALQPGTALL

SEQ ID NO: 4584 - protein, 9 aa, Homo sapiens
AILALLPAL

SEQ ID NO: 4585 - protein, 9 aa, Homo sapiens
LALLPALGL

SEQ ID NO: 4586 - protein, 9 aa, Homo sapiens
TARIRAVGL

SEQ ID NO: 4587 - protein, 9 aa, Homo sapiens
ALQPAAAIL

SEQ ID NO: 4588 - protein, 9 aa, Homo sapiens
LLPALGLLL

SEQ ID NO: 4589 - protein, 9 aa, Homo sapiens
QPGTALLCY

SEQ ID NO: 4590 - protein, 9 aa, Homo sapiens
ARIRAVGLL

SEQ ID NO: 4591 - protein, 9 aa, Homo sapiens
RIRAVGLLT

SEQ ID NO: 4592 - protein, 9 aa, Homo sapiens
PAAAILALL

SEQ ID NO: 4593 - protein, 9 aa, Homo sapiens
ALLPALGLL

SEQ ID NO: 4594 - protein, 9 aa, Homo sapiens
LPALGLLLW

SEQ ID NO: 4595 - protein, 9 aa, Homo sapiens
MKAVLLALL

SEQ ID NO: 4596 - protein, 9 aa, Homo sapiens
LLALLMAGL

SEQ ID NO: 4597 - protein, 9 aa, Homo sapiens
AQVSNEDCL

SEQ ID NO: 4598 - protein, 9 aa, Homo sapiens
CNASGAHAL

SEQ ID NO: 4599 - protein, 9 aa, Homo sapiens
APLQPTLGV

SEQ ID NO: 4600 - protein, 9 aa, Homo sapiens
FPAHPIYDL

SEQ ID NO: 4601 - protein, 9 aa, Homo sapiens
VPQASVPLL

SEQ ID NO: 4602 - protein, 9 aa, Homo sapiens
HPAQWEPVL

SEQ ID NO: 4603 - protein, 9 aa, Homo sapiens
LPPSLRCSL

SEQ ID NO: 4604 - protein, 9 aa, Homo sapiens
SPAPSRGQA

SEQ ID NO: 4605 - protein, 9 aa, Homo sapiens
VPHPDPPMA

SEQ ID NO: 4606 - protein, 9 aa, Homo sapiens
TPAGPMPCS

SEQ ID NO: 4607 - protein, 9 aa, Homo sapiens
PADGPSNPL

SEQ ID NO: 4608 - protein, 9 aa, Homo sapiens
HPDPPMALS

SEQ ID NO: 4609 - protein, 9 aa, Homo sapiens
DPPMALSRT

SEQ ID NO: 4610 - protein, 9 aa, Homo sapiens
TPTRQIGSI

SEQ ID NO: 4611 - protein, 9 aa, Homo sapiens
AFSTLNPVL

SEQ ID NO: 4612 - protein, 9 aa, Homo sapiens
HPIYDLSQV

SEQ ID NO: 4613 - protein, 9 aa, Homo sapiens
AGPMPCSRL

SEQ ID NO: 4614 - protein, 9 aa, Homo sapiens
SYRLWGAPL

SEQ ID NO: 4615 - protein, 9 aa, Homo sapiens
PEAHPNASL

SEQ ID NO: 4616 - protein, 9 aa, Homo sapiens
GPSNPLCCC

SEQ ID NO: 4617 - protein, 9 aa, Homo sapiens
APSRGQALR

SEQ ID NO: 4618 - protein, 9 aa, Homo sapiens
DPASYRLWG

SEQ ID NO: 4619 - protein, 9 aa, Homo sapiens
QPTLGVVPQ

SEQ ID NO: 4620 - protein, 9 aa, Homo sapiens
APVPHPDPP

SEQ ID NO: 4621 - protein, 9 aa, Homo sapiens
PHPDPPMAL

SEQ ID NO: 4622 - protein, 9 aa, Homo sapiens
GPAFSTLNP

SEQ ID NO: 4623 - protein, 9 aa, Homo sapiens
ARRTSRAVT

SEQ ID NO: 4624 - protein, 9 aa, Homo sapiens
TPTCATPAG

SEQ ID NO: 4625 - protein, 9 aa, Homo sapiens
PCSRLPPSL

SEQ ID NO: 4626 - protein, 9 aa, Homo sapiens
WGAPLQPTL

SEQ ID NO: 4627 - protein, 9 aa, Homo sapiens
VVPQASVPL

SEQ ID NO: 4628 - protein, 9 aa, Homo sapiens
DPPADGPSN

SEQ ID NO: 4629 - protein, 9 aa, Homo sapiens
FHGPAFSTL

SEQ ID NO: 4630 - protein, 9 aa, Homo sapiens
NPVLRHLFP

SEQ ID NO: 4631 - protein, 9 aa, Homo sapiens
FPQEAFPAH

SEQ ID NO: 4632 - protein, 9 aa, Homo sapiens
RTSRAVTPT

SEQ ID NO: 4633 - protein, 9 aa, Homo sapiens
RAVTPTCAT

SEQ ID NO: 4634 - protein, 9 aa, Homo sapiens
GPMPCSRLP

SEQ ID NO: 4635 - protein, 9 aa, Homo sapiens
MPCSRLPPS

SEQ ID NO: 4636 - protein, 9 aa, Homo sapiens
PPSLRCSLH

SEQ ID NO: 4637 - protein, 9 aa, Homo sapiens
SGDPASYRL

SEQ ID NO: 4638 - protein, 9 aa, Homo sapiens
LWGAPLQPT

SEQ ID NO: 4639 - protein, 9 aa, Homo sapiens
VPLLTHPAQ

SEQ ID NO: 4640 - protein, 9 aa, Homo sapiens
EPVLVPEAH

SEQ ID NO: 4641 - protein, 9 aa, Homo sapiens
VPEAHPNAS

SEQ ID NO: 4642 - protein, 9 aa, Homo sapiens
HPNASLTMY

SEQ ID NO: 4643 - protein, 9 aa, Homo sapiens
PPMALSRTP

SEQ ID NO: 4644 - protein, 9 aa, Homo sapiens
LSRTPTRQI

SEQ ID NO: 4645 - protein, 9 aa, Homo sapiens
PAPSRGQAL

SEQ ID NO: 4646 - protein, 9 aa, Homo sapiens
TCATPAGPM

SEQ ID NO: 4647 - protein, 9 aa, Homo sapiens
PVPHPDPPM

SEQ ID NO: 4648 - protein, 9 aa, Homo sapiens
PPADGPSNP

SEQ ID NO: 4649 - protein, 9 aa, Homo sapiens
CFHGPAFST

SEQ ID NO: 4650 - protein, 9 aa, Homo sapiens
TLNPVLRHL

SEQ ID NO: 4651 - protein, 9 aa, Homo sapiens
RHLFPQEAF

SEQ ID NO: 4652 - protein, 9 aa, Homo sapiens
QEAFPAHPI

SEQ ID NO: 4653 - protein, 9 aa, Homo sapiens
GPMPCSRLL

SEQ ID NO: 4654 - protein, 9 aa, Homo sapiens
MPCSRLLPS

SEQ ID NO: 4655 - protein, 9 aa, Homo sapiens
PCSRLLPSL

SEQ ID NO: 4656 - protein, 9 aa, Homo sapiens
LPSLRCSLH

SEQ ID NO: 4657 - protein, 9 aa, Homo sapiens
LLPSLRCSL

SEQ ID NO: 4658 - protein, 9 aa, Homo sapiens
SSRLWGAPL

SEQ ID NO: 4659 - protein, 9 aa, Homo sapiens
DPASSRLWG

SEQ ID NO: 4660 - protein, 9 aa, Homo sapiens
SGDPASSRL

SEQ ID NO: 4661 - protein, 9 aa, Homo sapiens
PASSRLWGA

SEQ ID NO: 4662 - protein, 9 aa, Homo sapiens
DPAQWEPVL

SEQ ID NO: 4663 - protein, 9 aa, Homo sapiens
VPLLTDPAQ

SEQ ID NO: 4664 - protein, 9 aa, Homo sapiens
ASVPLLTDL

SEQ ID NO: 4665 - protein, 9 aa, Homo sapiens
VPLLTDLAQ

SEQ ID NO: 4666 - protein, 9 aa, Homo sapiens
DLAQWEPVL

SEQ ID NO: 4667 - protein, 9 aa, Homo sapiens
TDLAQWEPV

SEQ ID NO: 4668 - protein, 9 aa, Homo sapiens
SVPLLTDLA

SEQ ID NO: 4669 - protein, 9 aa, Homo sapiens
ASVPLLTHL

SEQ ID NO: 4670 - protein, 9 aa, Homo sapiens
VPLLTHLAQ

SEQ ID NO: 4671 - protein, 9 aa, Homo sapiens
HLAQWEPVL

SEQ ID NO: 4672 - protein, 9 aa, Homo sapiens
THLAQWEPV

SEQ ID NO: 4673 - protein, 9 aa, Homo sapiens
LAQWEPVLV

SEQ ID NO: 4674 - protein, 9 aa, Homo sapiens
SVPLLTHLA

SEQ ID NO: 4675 - protein, 9 aa, Homo sapiens
ASLTMYVCT

SEQ ID NO: 4676 - protein, 9 aa, Homo sapiens
LTMYVCTPV

SEQ ID NO: 4677 - protein, 9 aa, Homo sapiens
YVCTPVPHP

SEQ ID NO: 4678 - protein, 9 aa, Homo sapiens
CTPVPHPDP

SEQ ID NO: 4679 - protein, 9 aa, Homo sapiens
TPTRQISSI

SEQ ID NO: 4680 - protein, 9 aa, Homo sapiens
SSIDTDPPA

SEQ ID NO: 4681 - protein, 9 aa, Homo sapiens
TPTRQISSS

SEQ ID NO: 4682 - protein, 9 aa, Homo sapiens
SSSDTDPPA

SEQ ID NO: 4683 - protein, 9 aa, Homo sapiens
TRQISSSDT

SEQ ID NO: 4684 - protein, 9 aa, Homo sapiens
ISSSDTDPP

SEQ ID NO: 4685 - protein, 9 aa, Homo sapiens
TPTRQIGSS

SEQ ID NO: 4686 - protein, 9 aa, Homo sapiens
GSSDTDPPA

SEQ ID NO: 4687 - protein, 9 aa, Homo sapiens
TRQIGSSDT

SEQ ID NO: 4688 - protein, 9 aa, Homo sapiens
IGSSDTDPP

SEQ ID NO: 4689 - protein, 9 aa, Homo sapiens
SDTDPPADG

SEQ ID NO: 4690 - protein, 9 aa, Homo sapiens
SRGQALRRA

SEQ ID NO: 4691 - protein, 9 aa, Homo sapiens
TARIRAVGL

SEQ ID NO: 4692 - protein, 9 aa, Homo sapiens
TVISKGCSL

SEQ ID NO: 4693 - protein, 9 aa, Homo sapiens
QPAAAILAL

SEQ ID NO: 4694 - protein, 9 aa, Homo sapiens
LLALLMAGL

SEQ ID NO: 4695 - protein, 9 aa, Homo sapiens
ALLMAGLAL

SEQ ID NO: 4696 - protein, 9 aa, Homo sapiens
ALQPGTALL

SEQ ID NO: 4697 - protein, 9 aa, Homo sapiens
ALQPAAAIL

SEQ ID NO: 4698 - protein, 9 aa, Homo sapiens
ALLPALGLL

SEQ ID NO: 4699 - protein, 9 aa, Homo sapiens
LLPALGLLL

SEQ ID NO: 4700 - protein, 9 aa, Homo sapiens
LLLWGPGQL

SEQ ID NO: 4701 - protein, 9 aa, Homo sapiens
LALQPGTAL

SEQ ID NO: 4702 - protein, 9 aa, Homo sapiens
AILALLPAL

SEQ ID NO: 4703 - protein, 9 aa, Homo sapiens
LALLPALGL

SEQ ID NO: 4704 - protein, 9 aa, Homo sapiens
NITCCDTDL

SEQ ID NO: 4705 - protein, 9 aa, Homo sapiens
PAAAILALL

SEQ ID NO: 4706 - protein, 9 aa, Homo sapiens
PAPSRGQAL

SEQ ID NO: 4707 - protein, 9 aa, Homo sapiens
SYRLWGAPL

SEQ ID NO: 4708 - protein, 9 aa, Homo sapiens
VPQASVPLL

SEQ ID NO: 4709 - protein, 9 aa, Homo sapiens
FPAHPIYDL

SEQ ID NO: 4710 - protein, 9 aa, Homo sapiens
HPAQWEPVL

SEQ ID NO: 4711 - protein, 9 aa, Homo sapiens
LPPSLRCSL

SEQ ID NO: 4712 - protein, 9 aa, Homo sapiens
TLNPVLRHL

SEQ ID NO: 4713 - protein, 9 aa, Homo sapiens
PPSLRCSLH

SEQ ID NO: 4714 - protein, 9 aa, Homo sapiens
NPVLRHLFP

SEQ ID NO: 4715 - protein, 9 aa, Homo sapiens
MPCSRLPPS

SEQ ID NO: 4716 - protein, 9 aa, Homo sapiens
SLRCSLHSA

SEQ ID NO: 4717 - protein, 9 aa, Homo sapiens
PADGPSNPL

SEQ ID NO: 4718 - protein, 9 aa, Homo sapiens
PASYRLWGA

SEQ ID NO: 4719 - protein, 9 aa, Homo sapiens
TPTRQIGSI

SEQ ID NO: 4720 - protein, 9 aa, Homo sapiens
VLRHLFPQE

SEQ ID NO: 4721 - protein, 9 aa, Homo sapiens
SGDPASYRL

SEQ ID NO: 4722 - protein, 9 aa, Homo sapiens
VVPQASVPL

SEQ ID NO: 4723 - protein, 9 aa, Homo sapiens
MALSRTPTR

SEQ ID NO: 4724 - protein, 9 aa, Homo sapiens
LSRTPTRQI

SEQ ID NO: 4725 - protein, 9 aa, Homo sapiens
WARRTSRAV

SEQ ID NO: 4726 - protein, 9 aa, Homo sapiens
PEAHPNASL

SEQ ID NO: 4727 - protein, 9 aa, Homo sapiens
PHPDPPMAL

SEQ ID NO: 4728 - protein, 9 aa, Homo sapiens
FHGPAFSTL

SEQ ID NO: 4729 - protein, 9 aa, Homo sapiens
AFSTLNPVL

SEQ ID NO: 4730 - protein, 9 aa, Homo sapiens
GPMPCSRLL

SEQ ID NO: 4731 - protein, 9 aa, Homo sapiens
LLPSLRCSL

SEQ ID NO: 4732 - protein, 9 aa, Homo sapiens
LPSLRCSLH

SEQ ID NO: 4733 - protein, 9 aa, Homo sapiens
MPCSRLLPS

SEQ ID NO: 4734 - protein, 9 aa, Homo sapiens
PCSRLLPSL

SEQ ID NO: 4735 - protein, 9 aa, Homo sapiens
SSRLWGAPL

SEQ ID NO: 4736 - protein, 9 aa, Homo sapiens
SGDPASSRL

SEQ ID NO: 4737 - protein, 9 aa, Homo sapiens
PASSRLWGA

SEQ ID NO: 4738 - protein, 9 aa, Homo sapiens
DPAQWEPVL

SEQ ID NO: 4739 - protein, 9 aa, Homo sapiens
VPLLTDPAQ

SEQ ID NO: 4740 - protein, 9 aa, Homo sapiens
DLAQWEPVL

SEQ ID NO: 4741 - protein, 9 aa, Homo sapiens
ASVPLLTDL

SEQ ID NO: 4742 - protein, 9 aa, Homo sapiens
VPLLTDLAQ

SEQ ID NO: 4743 - protein, 9 aa, Homo sapiens
HLAQWEPVL

SEQ ID NO: 4744 - protein, 9 aa, Homo sapiens
ASVPLLTHL

SEQ ID NO: 4745 - protein, 9 aa, Homo sapiens
VPLLTHLAQ

SEQ ID NO: 4746 - protein, 9 aa, Homo sapiens
SLTMYVCTP

SEQ ID NO: 4747 - protein, 9 aa, Homo sapiens
TPTRQISSI

SEQ ID NO: 4748 - protein, 9 aa, Homo sapiens
RTPTRQISS

SEQ ID NO: 4749 - protein, 9 aa, Homo sapiens
PTRQISSID

SEQ ID NO: 4750 - protein, 9 aa, Homo sapiens
TPTRQISSS

SEQ ID NO: 4751 - protein, 9 aa, Homo sapiens
PTRQISSSD

SEQ ID NO: 4752 - protein, 9 aa, Homo sapiens
QISSSDTDP

SEQ ID NO: 4753 - protein, 9 aa, Homo sapiens
TPTRQIGSS

SEQ ID NO: 4754 - protein, 9 aa, Homo sapiens
PTRQIGSSD

SEQ ID NO: 4755 - protein, 9 aa, Homo sapiens
QIGSSDTDP

SEQ ID NO: 4756 - protein, 9 aa, Homo sapiens
SSDTDPPAD

SEQ ID NO: 4757 - protein, 9 aa, Homo sapiens
SRGQALRRA

SEQ ID NO: 4758 - protein, 9 aa, Homo sapiens
RGQALRRAQ

SEQ ID NO: 4759 - protein, 9 aa, Homo sapiens
LALQPGTAL

SEQ ID NO: 4760 - protein, 9 aa, Homo sapiens
ALQPGTALL

SEQ ID NO: 4761 - protein, 9 aa, Homo sapiens
TARIRAVGL

SEQ ID NO: 4762 - protein, 9 aa, Homo sapiens
CNASGAHAL

SEQ ID NO: 4763 - protein, 9 aa, Homo sapiens
AHALQPAAA

SEQ ID NO: 4764 - protein, 9 aa, Homo sapiens
QPAAAILAL

SEQ ID NO: 4765 - protein, 9 aa, Homo sapiens
MKAVLLALL

SEQ ID NO: 4766 - protein, 9 aa, Homo sapiens
LLALLMAGL

SEQ ID NO: 4767 - protein, 9 aa, Homo sapiens
LQVENCTQL

SEQ ID NO: 4768 - protein, 9 aa, Homo sapiens
ALQPAAAIL

SEQ ID NO: 4769 - protein, 9 aa, Homo sapiens
AILALLPAL

SEQ ID NO: 4770 - protein, 9 aa, Homo sapiens
ALLPALGLL

SEQ ID NO: 4771 - protein, 9 aa, Homo sapiens
LLLWGPGQL

SEQ ID NO: 4772 - protein, 9 aa, Homo sapiens
ALLMAGLAL

SEQ ID NO: 4773 - protein, 9 aa, Homo sapiens
AQVSNEDCL

SEQ ID NO: 4774 - protein, 9 aa, Homo sapiens
ARIRAVGLL

SEQ ID NO: 4775 - protein, 9 aa, Homo sapiens
TVISKGCSL

SEQ ID NO: 4776 - protein, 9 aa, Homo sapiens
PAAAILALL

SEQ ID NO: 4777 - protein, 9 aa, Homo sapiens
LALLPALGL

SEQ ID NO: 4778 - protein, 9 aa, Homo sapiens
NITCCDTDL

SEQ ID NO: 4779 - protein, 9 aa, Homo sapiens
LLPALGLLL

SEQ ID NO: 4780 - protein, 9 aa, Homo sapiens
KAVLLALLM

SEQ ID NO: 4781 - protein, 9 aa, Homo sapiens
IRAVGLLTV

SEQ ID NO: 4782 - protein, 9 aa, Homo sapiens
PHPDPPMAL

SEQ ID NO: 4783 - protein, 9 aa, Homo sapiens
FHGPAFSTL

SEQ ID NO: 4784 - protein, 9 aa, Homo sapiens
RHLFPQEAF

SEQ ID NO: 4785 - protein, 9 aa, Homo sapiens
AHPNASLTM

SEQ ID NO: 4786 - protein, 9 aa, Homo sapiens
WGAPLQPTL

SEQ ID NO: 4787 - protein, 9 aa, Homo sapiens
HPAQWEPVL

SEQ ID NO: 4788 - protein, 9 aa, Homo sapiens
TLNPVLRHL

SEQ ID NO: 4789 - protein, 9 aa, Homo sapiens
SGDPASYRL

SEQ ID NO: 4790 - protein, 9 aa, Homo sapiens
AFSTLNPVL

SEQ ID NO: 4791 - protein, 9 aa, Homo sapiens
AGPMPCSRL

SEQ ID NO: 4792 - protein, 9 aa, Homo sapiens
PCSRLPPSL

SEQ ID NO: 4793 - protein, 9 aa, Homo sapiens
VVPQASVPL

SEQ ID NO: 4794 - protein, 9 aa, Homo sapiens
FPAHPIYDL

SEQ ID NO: 4795 - protein, 9 aa, Homo sapiens
THRTTTWAR

SEQ ID NO: 4796 - protein, 9 aa, Homo sapiens
VPQASVPLL

SEQ ID NO: 4797 - protein, 9 aa, Homo sapiens
PEAHPNASL

SEQ ID NO: 4798 - protein, 9 aa, Homo sapiens
PADGPSNPL

SEQ ID NO: 4799 - protein, 9 aa, Homo sapiens
LPPSLRCSL

SEQ ID NO: 4800 - protein, 9 aa, Homo sapiens
LHSACCSGD

SEQ ID NO: 4801 - protein, 9 aa, Homo sapiens
THPAQWEPV

SEQ ID NO: 4802 - protein, 9 aa, Homo sapiens
PAPSRGQAL

SEQ ID NO: 4803 - protein, 9 aa, Homo sapiens
GPMPCSRLL

SEQ ID NO: 4804 - protein, 9 aa, Homo sapiens
PCSRLLPSL

SEQ ID NO: 4805 - protein, 9 aa, Homo sapiens
LLPSLRCSL

SEQ ID NO: 4806 - protein, 9 aa, Homo sapiens
SGDPASSRL

SEQ ID NO: 4807 - protein, 9 aa, Homo sapiens
SSRLWGAPL

SEQ ID NO: 4808 - protein, 9 aa, Homo sapiens
DPAQWEPVL

SEQ ID NO: 4809 - protein, 9 aa, Homo sapiens
DLAQWEPVL

SEQ ID NO: 4810 - protein, 9 aa, Homo sapiens
ASVPLLTDL

SEQ ID NO: 4811 - protein, 9 aa, Homo sapiens
HLAQWEPVL

SEQ ID NO: 4812 - protein, 9 aa, Homo sapiens
ASVPLLTHL

SEQ ID NO: 4813 - protein, 9 aa, Homo sapiens
THLAQWEPV

SEQ ID NO: 4814 - protein, 9 aa, Homo sapiens
TMYVCTPVP

SEQ ID NO: 4815 - protein, 9 aa, Homo sapiens
YVCTPVPHP

SEQ ID NO: 4816 - protein, 9 aa, Homo sapiens
MYVCTPVPH

SEQ ID NO: 4817 - protein, 9 aa, Homo sapiens
VCTPVPHPD

SEQ ID NO: 4818 - protein, 9 aa, Homo sapiens
CTPVPHPDP

SEQ ID NO: 4819 - protein, 9 aa, Homo sapiens
ASLTMYVCT

SEQ ID NO: 4820 - protein, 9 aa, Homo sapiens
SLTMYVCTP

SEQ ID NO: 4821 - protein, 9 aa, Homo sapiens
SRTPTRQIS

SEQ ID NO: 4822 - protein, 9 aa, Homo sapiens
ISSIDTDPP

SEQ ID NO: 4823 - protein, 9 aa, Homo sapiens
TPTRQISSI

SEQ ID NO: 4824 - protein, 9 aa, Homo sapiens
RQISSIDTD

SEQ ID NO: 4825 - protein, 9 aa, Homo sapiens
SSIDTDPPA

SEQ ID NO: 4826 - protein, 9 aa, Homo sapiens
PTRQISSID

SEQ ID NO: 4827 - protein, 9 aa, Homo sapiens
TRQISSIDT

SEQ ID NO: 4828 - protein, 9 aa, Homo sapiens
QISSIDTDP

SEQ ID NO: 4829 - protein, 9 aa, Homo sapiens
ISSSDTDPP

SEQ ID NO: 4830 - protein, 9 aa, Homo sapiens
SSSDTDPPA

SEQ ID NO: 4831 - protein, 9 aa, Homo sapiens
TPTRQISSS

SEQ ID NO: 4832 - protein, 9 aa, Homo sapiens
PTRQISSSD

SEQ ID NO: 4833 - protein, 9 aa, Homo sapiens
TRQISSSDT

SEQ ID NO: 4834 - protein, 9 aa, Homo sapiens
RQISSSDTD

SEQ ID NO: 4835 - protein, 9 aa, Homo sapiens
QISSSDTDP

SEQ ID NO: 4836 - protein, 9 aa, Homo sapiens
GSSDTDPPA

SEQ ID NO: 4837 - protein, 9 aa, Homo sapiens
IGSSDTDPP

SEQ ID NO: 4838 - protein, 9 aa, Homo sapiens
SSDTDPPAD

SEQ ID NO: 4839 - protein, 9 aa, Homo sapiens
SDTDPPADG

SEQ ID NO: 4840 - protein, 9 aa, Homo sapiens
TPTRQIGSS

SEQ ID NO: 4841 - protein, 9 aa, Homo sapiens
TRQIGSSDT

SEQ ID NO: 4842 - protein, 9 aa, Homo sapiens
RQIGSSDTD

SEQ ID NO: 4843 - protein, 9 aa, Homo sapiens
PTRQIGSSD

SEQ ID NO: 4844 - protein, 9 aa, Homo sapiens
SRGQALRRA

SEQ ID NO: 4845 - protein, 9 aa, Homo sapiens
RGQALRRAQ

SEQ ID NO: 4846 - protein, 9 aa, Homo sapiens
ARIRAVGLL

SEQ ID NO: 4847 - protein, 9 aa, Homo sapiens
RAVGLLTVI

SEQ ID NO: 4848 - protein, 9 aa, Homo sapiens
LALQPGTAL

SEQ ID NO: 4849 - protein, 9 aa, Homo sapiens
IRAVGLLTV

SEQ ID NO: 4850 - protein, 9 aa, Homo sapiens
VGLLTVISK

SEQ ID NO: 4851 - protein, 9 aa, Homo sapiens
AILALLPAL

SEQ ID NO: 4852 - protein, 9 aa, Homo sapiens
LALLPALGL

SEQ ID NO: 4853 - protein, 9 aa, Homo sapiens
KAVLLALLM

SEQ ID NO: 4854 - protein, 9 aa, Homo sapiens
ALQPGTALL

SEQ ID NO: 4855 - protein, 9 aa, Homo sapiens
LQVENCTQL

SEQ ID NO: 4856 - protein, 9 aa, Homo sapiens
ALLPALGLL

SEQ ID NO: 4857 - protein, 9 aa, Homo sapiens
LLLWGPGQL

SEQ ID NO: 4858 - protein, 9 aa, Homo sapiens
ALLMAGLAL

SEQ ID NO: 4859 - protein, 9 aa, Homo sapiens
TALLCYSCK

SEQ ID NO: 4860 - protein, 9 aa, Homo sapiens
LGEQCWTAR

SEQ ID NO: 4861 - protein, 9 aa, Homo sapiens
TVISKGCSL

SEQ ID NO: 4862 - protein, 9 aa, Homo sapiens
ALQPAAAIL

SEQ ID NO: 4863 - protein, 9 aa, Homo sapiens
QPAAAILAL

SEQ ID NO: 4864 - protein, 9 aa, Homo sapiens
MKAVLLALL

SEQ ID NO: 4865 - protein, 9 aa, Homo sapiens
LLALLMAGL

SEQ ID NO: 4866 - protein, 9 aa, Homo sapiens
SQDYYVGKK

SEQ ID NO: 4867 - protein, 9 aa, Homo sapiens
DYYVGKKNI

SEQ ID NO: 4868 - protein, 9 aa, Homo sapiens
NITCCDTDL

SEQ ID NO: 4869 - protein, 9 aa, Homo sapiens
CNASGAHAL

SEQ ID NO: 4870 - protein, 9 aa, Homo sapiens
HALQPAAAI

SEQ ID NO: 4871 - protein, 9 aa, Homo sapiens
PAAAILALL

SEQ ID NO: 4872 - protein, 9 aa, Homo sapiens
AQVSNEDCL

SEQ ID NO: 4873 - protein, 9 aa, Homo sapiens
GEQCWTARI

SEQ ID NO: 4874 - protein, 9 aa, Homo sapiens
TARIRAVGL

SEQ ID NO: 4875 - protein, 9 aa, Homo sapiens
GLLTVISKG

SEQ ID NO: 4876 - protein, 9 aa, Homo sapiens
LLPALGLLL

SEQ ID NO: 4877 - protein, 9 aa, Homo sapiens
EQCWTARIR

SEQ ID NO: 4878 - protein, 9 aa, Homo sapiens
CVDDSQDYY

SEQ ID NO: 4879 - protein, 9 aa, Homo sapiens
DSQDYYVGK

SEQ ID NO: 4880 - protein, 9 aa, Homo sapiens
HRTTTWARR

SEQ ID NO: 4881 - protein, 9 aa, Homo sapiens
RHLFPQEAF

SEQ ID NO: 4882 - protein, 9 aa, Homo sapiens
SRLPPSLRC

SEQ ID NO: 4883 - protein, 9 aa, Homo sapiens
RRTSRAVTP

SEQ ID NO: 4884 - protein, 9 aa, Homo sapiens
YRLWGAPLQ

SEQ ID NO: 4885 - protein, 9 aa, Homo sapiens
WGAPLQPTL

SEQ ID NO: 4886 - protein, 9 aa, Homo sapiens
APSRGQALR

SEQ ID NO: 4887 - protein, 9 aa, Homo sapiens
PSRGQALRR

SEQ ID NO: 4888 - protein, 9 aa, Homo sapiens
AGPMPCSRL

SEQ ID NO: 4889 - protein, 9 aa, Homo sapiens
SGDPASYRL

SEQ ID NO: 4890 - protein, 9 aa, Homo sapiens
PADGPSNPL

SEQ ID NO: 4891 - protein, 9 aa, Homo sapiens
AFSTLNPVL

SEQ ID NO: 4892 - protein, 9 aa, Homo sapiens
STLNPVLRH

SEQ ID NO: 4893 - protein, 9 aa, Homo sapiens
FPAHPIYDL

SEQ ID NO: 4894 - protein, 9 aa, Homo sapiens
SVVSPAPSR

SEQ ID NO: 4895 - protein, 9 aa, Homo sapiens
SRGQALRRA

SEQ ID NO: 4896 - protein, 9 aa, Homo sapiens
RGQALRRAR

SEQ ID NO: 4897 - protein, 9 aa, Homo sapiens
ARRTSRAVT

SEQ ID NO: 4898 - protein, 9 aa, Homo sapiens
VVPQASVPL

SEQ ID NO: 4899 - protein, 9 aa, Homo sapiens
HPAQWEPVL

SEQ ID NO: 4900 - protein, 9 aa, Homo sapiens
PEAHPNASL

SEQ ID NO: 4901 - protein, 9 aa, Homo sapiens
PDPPMALSR

SEQ ID NO: 4902 - protein, 9 aa, Homo sapiens
MALSRTPTR

SEQ ID NO: 4903 - protein, 9 aa, Homo sapiens
TRQIGSIDT

SEQ ID NO: 4904 - protein, 9 aa, Homo sapiens
TTWARRTSR

SEQ ID NO: 4905 - protein, 9 aa, Homo sapiens
PCSRLPPSL

SEQ ID NO: 4906 - protein, 9 aa, Homo sapiens
CSRLPPSLR

SEQ ID NO: 4907 - protein, 9 aa, Homo sapiens
CSGDPASYR

SEQ ID NO: 4908 - protein, 9 aa, Homo sapiens
VPQASVPLL

SEQ ID NO: 4909 - protein, 9 aa, Homo sapiens
RQIGSIDTD

SEQ ID NO: 4910 - protein, 9 aa, Homo sapiens
FHGPAFSTL

SEQ ID NO: 4911 - protein, 9 aa, Homo sapiens
TLNPVLRHL

SEQ ID NO: 4912 - protein, 9 aa, Homo sapiens
EAFPAHPIY

SEQ ID NO: 4913 - protein, 9 aa, Homo sapiens
SRAVTPTCA

SEQ ID NO: 4914 - protein, 9 aa, Homo sapiens
PAGPMPCSR

SEQ ID NO: 4915 - protein, 9 aa, Homo sapiens
LPPSLRCSL

SEQ ID NO: 4916 - protein, 9 aa, Homo sapiens
LRCSLHSAC

SEQ ID NO: 4917 - protein, 9 aa, Homo sapiens
CCSGDPASY

SEQ ID NO: 4918 - protein, 9 aa, Homo sapiens
SYRLWGAPL

SEQ ID NO: 4919 - protein, 9 aa, Homo sapiens
QASVPLLTH

SEQ ID NO: 4920 - protein, 9 aa, Homo sapiens
AHPNASLTM

SEQ ID NO: 4921 - protein, 9 aa, Homo sapiens
HPNASLTMY

SEQ ID NO: 4922 - protein, 9 aa, Homo sapiens
PHPDPPMAL

SEQ ID NO: 4923 - protein, 9 aa, Homo sapiens
PSNPLCCCF

SEQ ID NO: 4924 - protein, 9 aa, Homo sapiens
FSTLNPVLR

SEQ ID NO: 4925 - protein, 9 aa, Homo sapiens
LRHLFPQEA

SEQ ID NO: 4926 - protein, 9 aa, Homo sapiens
THRTTTWAR

SEQ ID NO: 4927 - protein, 9 aa, Homo sapiens
EPVLVPEAH

SEQ ID NO: 4928 - protein, 9 aa, Homo sapiens
PVPHPDPPM

SEQ ID NO: 4929 - protein, 9 aa, Homo sapiens
SRTPTRQIG

SEQ ID NO: 4930 - protein, 9 aa, Homo sapiens
CCCFHGPAF

SEQ ID NO: 4931 - protein, 9 aa, Homo sapiens
LNPVLRHLF

SEQ ID NO: 4932 - protein, 9 aa, Homo sapiens
SRLLPSLRC

SEQ ID NO: 4933 - protein, 9 aa, Homo sapiens
GPMPCSRLL

SEQ ID NO: 4934 - protein, 9 aa, Homo sapiens
PCSRLLPSL

SEQ ID NO: 4935 - protein, 9 aa, Homo sapiens
CSRLLPSLR

SEQ ID NO: 4936 - protein, 9 aa, Homo sapiens
LLPSLRCSL

SEQ ID NO: 4937 - protein, 9 aa, Homo sapiens
LPSLRCSLH

SEQ ID NO: 4938 - protein, 9 aa, Homo sapiens
RLLPSLRCS

SEQ ID NO: 4939 - protein, 9 aa, Homo sapiens
SRLWGAPLQ

SEQ ID NO: 4940 - protein, 9 aa, Homo sapiens
SGDPASSRL

SEQ ID NO: 4941 - protein, 9 aa, Homo sapiens
CSGDPASSR

SEQ ID NO: 4942 - protein, 9 aa, Homo sapiens
SSRLWGAPL

SEQ ID NO: 4943 - protein, 9 aa, Homo sapiens
DPAQWEPVL

SEQ ID NO: 4944 - protein, 9 aa, Homo sapiens
ASVPLLTDP

SEQ ID NO: 4945 - protein, 9 aa, Homo sapiens
ASVPLLTDL

SEQ ID NO: 4946 - protein, 9 aa, Homo sapiens
DLAQWEPVL

SEQ ID NO: 4947 - protein, 9 aa, Homo sapiens
ASVPLLTHL

SEQ ID NO: 4948 - protein, 9 aa, Homo sapiens
HLAQWEPVL

SEQ ID NO: 4949 - protein, 9 aa, Homo sapiens
MYVCTPVPH

SEQ ID NO: 4950 - protein, 9 aa, Homo sapiens
ASLTMYVCT

SEQ ID NO: 4951 - protein, 9 aa, Homo sapiens
TMYVCTPVP

SEQ ID NO: 4952 - protein, 9 aa, Homo sapiens
TRQISSIDT

SEQ ID NO: 4953 - protein, 9 aa, Homo sapiens
SRTPTRQIS

SEQ ID NO: 4954 - protein, 9 aa, Homo sapiens
TPTRQISSI

SEQ ID NO: 4955 - protein, 9 aa, Homo sapiens
RQISSIDTD

SEQ ID NO: 4956 - protein, 9 aa, Homo sapiens
RTPTRQISS

SEQ ID NO: 4957 - protein, 9 aa, Homo sapiens
TRQISSSDT

SEQ ID NO: 4958 - protein, 9 aa, Homo sapiens
RQISSSDTD

SEQ ID NO: 4959 - protein, 9 aa, Homo sapiens
PTRQISSSD

SEQ ID NO: 4960 - protein, 9 aa, Homo sapiens
TRQIGSSDT

SEQ ID NO: 4961 - protein, 9 aa, Homo sapiens
RQIGSSDTD

SEQ ID NO: 4962 - protein, 9 aa, Homo sapiens
SRGQALRRA

SEQ ID NO: 4963 - protein, 9 aa, Homo sapiens
ARIRAVGLL

SEQ ID NO: 4964 - protein, 9 aa, Homo sapiens
IRAVGLLTV

SEQ ID NO: 4965 - protein, 9 aa, Homo sapiens
ALLMAGLAL

SEQ ID NO: 4966 - protein, 9 aa, Homo sapiens
AILALLPAL

SEQ ID NO: 4967 - protein, 9 aa, Homo sapiens
LALLPALGL

SEQ ID NO: 4968 - protein, 9 aa, Homo sapiens
ALLPALGLL

SEQ ID NO: 4969 - protein, 9 aa, Homo sapiens
KAVLLALLM

SEQ ID NO: 4970 - protein, 9 aa, Homo sapiens
AQVSNEDCL

SEQ ID NO: 4971 - protein, 9 aa, Homo sapiens
RAVGLLTVI

SEQ ID NO: 4972 - protein, 9 aa, Homo sapiens
ALQPAAAIL

SEQ ID NO: 4973 - protein, 9 aa, Homo sapiens
LLLWGPGQL

SEQ ID NO: 4974 - protein, 9 aa, Homo sapiens
LALQPGTAL

SEQ ID NO: 4975 - protein, 9 aa, Homo sapiens
ALQPGTALL

SEQ ID NO: 4976 - protein, 9 aa, Homo sapiens
LCYSCKAQV

SEQ ID NO: 4977 - protein, 9 aa, Homo sapiens
LQVENCTQL

SEQ ID NO: 4978 - protein, 9 aa, Homo sapiens
GEQCWTARI

SEQ ID NO: 4979 - protein, 9 aa, Homo sapiens
TARIRAVGL

SEQ ID NO: 4980 - protein, 9 aa, Homo sapiens
TVISKGCSL

SEQ ID NO: 4981 - protein, 9 aa, Homo sapiens
CNASGAHAL

SEQ ID NO: 4982 - protein, 9 aa, Homo sapiens
VSNEDCLQV

SEQ ID NO: 4983 - protein, 9 aa, Homo sapiens
DYYVGKKNI

SEQ ID NO: 4984 - protein, 9 aa, Homo sapiens
NITCCDTDL

SEQ ID NO: 4985 - protein, 9 aa, Homo sapiens
HALQPAAAI

SEQ ID NO: 4986 - protein, 9 aa, Homo sapiens
QPAAAILAL

SEQ ID NO: 4987 - protein, 9 aa, Homo sapiens
PAAAILALL

SEQ ID NO: 4988 - protein, 9 aa, Homo sapiens
LLPALGLLL

SEQ ID NO: 4989 - protein, 9 aa, Homo sapiens
RRTSRAVTP

SEQ ID NO: 4990 - protein, 9 aa, Homo sapiens
SRLPPSLRC

SEQ ID NO: 4991 - protein, 9 aa, Homo sapiens
YRLWGAPLQ

SEQ ID NO: 4992 - protein, 9 aa, Homo sapiens
RHLFPQEAF

SEQ ID NO: 4993 - protein, 9 aa, Homo sapiens
SGDPASYRL

SEQ ID NO: 4994 - protein, 9 aa, Homo sapiens
HRTTTWARR

SEQ ID NO: 4995 - protein, 9 aa, Homo sapiens
AGPMPCSRL

SEQ ID NO: 4996 - protein, 9 aa, Homo sapiens
WGAPLQPTL

SEQ ID NO: 4997 - protein, 9 aa, Homo sapiens
APLQPTLGV

SEQ ID NO: 4998 - protein, 9 aa, Homo sapiens
VPQASVPLL

SEQ ID NO: 4999 - protein, 9 aa, Homo sapiens
SRTPTRQIG

SEQ ID NO: 5000 - protein, 9 aa, Homo sapiens
AFSTLNPVL

SEQ ID NO: 5001 - protein, 9 aa, Homo sapiens
YDLSQVWSV

SEQ ID NO: 5002 - protein, 9 aa, Homo sapiens
ARRTSRAVT

SEQ ID NO: 5003 - protein, 9 aa, Homo sapiens
PCSRLPPSL

SEQ ID NO: 5004 - protein, 9 aa, Homo sapiens
LPPSLRCSL

SEQ ID NO: 5005 - protein, 9 aa, Homo sapiens
LRCSLHSAC

SEQ ID NO: 5006 - protein, 9 aa, Homo sapiens
VVPQASVPL

SEQ ID NO: 5007 - protein, 9 aa, Homo sapiens
HPAQWEPVL

SEQ ID NO: 5008 - protein, 9 aa, Homo sapiens
FHGPAFSTL

SEQ ID NO: 5009 - protein, 9 aa, Homo sapiens
PAFSTLNPV

SEQ ID NO: 5010 - protein, 9 aa, Homo sapiens
TLNPVLRHL

SEQ ID NO: 5011 - protein, 9 aa, Homo sapiens
FPAHPIYDL

SEQ ID NO: 5012 - protein, 9 aa, Homo sapiens
HPIYDLSQV

SEQ ID NO: 5013 - protein, 9 aa, Homo sapiens
PAPSRGQAL

SEQ ID NO: 5014 - protein, 9 aa, Homo sapiens
SRGQALRRA

SEQ ID NO: 5015 - protein, 9 aa, Homo sapiens
SRAVTPTCA

SEQ ID NO: 5016 - protein, 9 aa, Homo sapiens
SYRLWGAPL

SEQ ID NO: 5017 - protein, 9 aa, Homo sapiens
PEAHPNASL

SEQ ID NO: 5018 - protein, 9 aa, Homo sapiens
AHPNASLTM

SEQ ID NO: 5019 - protein, 9 aa, Homo sapiens
PHPDPPMAL

SEQ ID NO: 5020 - protein, 9 aa, Homo sapiens
TRQIGSIDT

SEQ ID NO: 5021 - protein, 9 aa, Homo sapiens
PADGPSNPL

SEQ ID NO: 5022 - protein, 9 aa, Homo sapiens
LRHLFPQEA

SEQ ID NO: 5023 - protein, 9 aa, Homo sapiens
TCATPAGPM

SEQ ID NO: 5024 - protein, 9 aa, Homo sapiens
PLQPTLGVV

SEQ ID NO: 5025 - protein, 9 aa, Homo sapiens
LGVVPQASV

SEQ ID NO: 5026 - protein, 9 aa, Homo sapiens
PAQWEPVLV

SEQ ID NO: 5027 - protein, 9 aa, Homo sapiens
PNASLTMYV

SEQ ID NO: 5028 - protein, 9 aa, Homo sapiens
PVPHPDPPM

SEQ ID NO: 5029 - protein, 9 aa, Homo sapiens
LSRTPTRQI

SEQ ID NO: 5030 - protein, 9 aa, Homo sapiens
TPTRQIGSI

SEQ ID NO: 5031 - protein, 9 aa, Homo sapiens
PSNPLCCCF

SEQ ID NO: 5032 - protein, 9 aa, Homo sapiens
CCCFHGPAF

SEQ ID NO: 5033 - protein, 9 aa, Homo sapiens
QEAFPAHPI

SEQ ID NO: 5034 - protein, 9 aa, Homo sapiens
WARRTSRAV

SEQ ID NO: 5035 - protein, 9 aa, Homo sapiens
THPAQWEPV

SEQ ID NO: 5036 - protein, 9 aa, Homo sapiens
LTMYVCAPV

SEQ ID NO: 5037 - protein, 9 aa, Homo sapiens
LNPVLRHLF

SEQ ID NO: 5038 - protein, 9 aa, Homo sapiens
DLSQVWSVV

SEQ ID NO: 5039 - protein, 9 aa, Homo sapiens
GPMPCSRLL

SEQ ID NO: 5040 - protein, 9 aa, Homo sapiens
SRLLPSLRC

SEQ ID NO: 5041 - protein, 9 aa, Homo sapiens
PCSRLLPSL

SEQ ID NO: 5042 - protein, 9 aa, Homo sapiens
LLPSLRCSL

SEQ ID NO: 5043 - protein, 9 aa, Homo sapiens
RLLPSLRCS

SEQ ID NO: 5044 - protein, 9 aa, Homo sapiens
SRLWGAPLQ

SEQ ID NO: 5045 - protein, 9 aa, Homo sapiens
SGDPASSRL

SEQ ID NO: 5046 - protein, 9 aa, Homo sapiens
SSRLWGAPL

SEQ ID NO: 5047 - protein, 9 aa, Homo sapiens
DPAQWEPVL

SEQ ID NO: 5048 - protein, 9 aa, Homo sapiens
TDPAQWEPV

SEQ ID NO: 5049 - protein, 9 aa, Homo sapiens
ASVPLLTDL

SEQ ID NO: 5050 - protein, 9 aa, Homo sapiens
DLAQWEPVL

SEQ ID NO: 5051 - protein, 9 aa, Homo sapiens
TDLAQWEPV

SEQ ID NO: 5052 - protein, 9 aa, Homo sapiens
ASVPLLTHL

SEQ ID NO: 5053 - protein, 9 aa, Homo sapiens
HLAQWEPVL

SEQ ID NO: 5054 - protein, 9 aa, Homo sapiens
THLAQWEPV

SEQ ID NO: 5055 - protein, 9 aa, Homo sapiens
LAQWEPVLV

SEQ ID NO: 5056 - protein, 9 aa, Homo sapiens
LTMYVCTPV

SEQ ID NO: 5057 - protein, 9 aa, Homo sapiens
ASLTMYVCT

SEQ ID NO: 5058 - protein, 9 aa, Homo sapiens
TMYVCTPVP

SEQ ID NO: 5059 - protein, 9 aa, Homo sapiens
SRTPTRQIS

SEQ ID NO: 5060 - protein, 9 aa, Homo sapiens
TRQISSIDT

SEQ ID NO: 5061 - protein, 9 aa, Homo sapiens
TPTRQISSI

SEQ ID NO: 5062 - protein, 9 aa, Homo sapiens
RQISSIDTD

SEQ ID NO: 5063 - protein, 9 aa, Homo sapiens
TRQISSSDT

SEQ ID NO: 5064 - protein, 9 aa, Homo sapiens
RQISSSDTD

SEQ ID NO: 5065 - protein, 9 aa, Homo sapiens
TRQIGSSDT

SEQ ID NO: 5066 - protein, 9 aa, Homo sapiens
RQIGSSDTD

SEQ ID NO: 5067 - protein, 9 aa, Homo sapiens
GSSDTDPPA

SEQ ID NO: 5068 - protein, 9 aa, Homo sapiens
SRGQALRRA

SEQ ID NO: 5069 - protein, 9 aa, Homo sapiens
GEQCWTARI

SEQ ID NO: 5070 - protein, 9 aa, Homo sapiens
ARIRAVGLL

SEQ ID NO: 5071 - protein, 9 aa, Homo sapiens
ALLPALGLL

SEQ ID NO: 5072 - protein, 9 aa, Homo sapiens
ALQPGTALL

SEQ ID NO: 5073 - protein, 9 aa, Homo sapiens
ALLMAGLAL

SEQ ID NO: 5074 - protein, 9 aa, Homo sapiens
ALQPAAAIL

SEQ ID NO: 5075 - protein, 9 aa, Homo sapiens
AILALLPAL

SEQ ID NO: 5076 - protein, 9 aa, Homo sapiens
QPAAAILAL

SEQ ID NO: 5077 - protein, 9 aa, Homo sapiens
AQVSNEDCL

SEQ ID NO: 5078 - protein, 9 aa, Homo sapiens
CNASGAHAL

SEQ ID NO: 5079 - protein, 9 aa, Homo sapiens
LALLPALGL

SEQ ID NO: 5080 - protein, 9 aa, Homo sapiens
LPALGLLLW

SEQ ID NO: 5081 - protein, 9 aa, Homo sapiens
LALQPGTAL

SEQ ID NO: 5082 - protein, 9 aa, Homo sapiens
QPGTALLCY

SEQ ID NO: 5083 - protein, 9 aa, Homo sapiens
NEDCLQVEN

SEQ ID NO: 5084 - protein, 9 aa, Homo sapiens
TARIRAVGL

SEQ ID NO: 5085 - protein, 9 aa, Homo sapiens
TVISKGCSL

SEQ ID NO: 5086 - protein, 9 aa, Homo sapiens
PAAAILALL

SEQ ID NO: 5087 - protein, 9 aa, Homo sapiens
LLPALGLLL

SEQ ID NO: 5088 - protein, 9 aa, Homo sapiens
LLLWGPGQL

SEQ ID NO: 5089 - protein, 9 aa, Homo sapiens
MKAVLLALL

SEQ ID NO: 5090 - protein, 9 aa, Homo sapiens
LQVENCTQL

SEQ ID NO: 5091 - protein, 9 aa, Homo sapiens
NCVDDSQDY

SEQ ID NO: 5092 - protein, 9 aa, Homo sapiens
CVDDSQDYY

SEQ ID NO: 5093 - protein, 9 aa, Homo sapiens
HALQPAAAI

SEQ ID NO: 5094 - protein, 9 aa, Homo sapiens
LLALLMAGL

SEQ ID NO: 5095 - protein, 9 aa, Homo sapiens
VENCTQLGE

SEQ ID NO: 5096 - protein, 9 aa, Homo sapiens
CTQLGEQCW

SEQ ID NO: 5097 - protein, 9 aa, Homo sapiens
RAVGLLTVI

SEQ ID NO: 5098 - protein, 9 aa, Homo sapiens
NITCCDTDL

SEQ ID NO: 5099 - protein, 9 aa, Homo sapiens
DYYVGKKNI

SEQ ID NO: 5100 - protein, 9 aa, Homo sapiens
AAILALLPA

SEQ ID NO: 5101 - protein, 9 aa, Homo sapiens
PEAHPNASL

SEQ ID NO: 5102 - protein, 9 aa, Homo sapiens
QEAFPAHPI

SEQ ID NO: 5103 - protein, 9 aa, Homo sapiens
EAFPAHPIY

SEQ ID NO: 5104 - protein, 9 aa, Homo sapiens
AFSTLNPVL

SEQ ID NO: 5105 - protein, 9 aa, Homo sapiens
SGDPASYRL

SEQ ID NO: 5106 - protein, 9 aa, Homo sapiens
PHPDPPMAL

SEQ ID NO: 5107 - protein, 9 aa, Homo sapiens
FHGPAFSTL

SEQ ID NO: 5108 - protein, 9 aa, Homo sapiens
TLNPVLRHL

SEQ ID NO: 5109 - protein, 9 aa, Homo sapiens
AGPMPCSRL

SEQ ID NO: 5110 - protein, 9 aa, Homo sapiens
WGAPLQPTL

SEQ ID NO: 5111 - protein, 9 aa, Homo sapiens
PLLTHPAQW

SEQ ID NO: 5112 - protein, 9 aa, Homo sapiens
LNPVLRHLF

SEQ ID NO: 5113 - protein, 9 aa, Homo sapiens
PAPSRGQAL

SEQ ID NO: 5114 - protein, 9 aa, Homo sapiens
PCSRLPPSL

SEQ ID NO: 5115 - protein, 9 aa, Homo sapiens
CCSGDPASY

SEQ ID NO: 5116 - protein, 9 aa, Homo sapiens
GDPASYRLW

SEQ ID NO: 5117 - protein, 9 aa, Homo sapiens
PADGPSNPL

SEQ ID NO: 5118 - protein, 9 aa, Homo sapiens
PSNPLCCCF

SEQ ID NO: 5119 - protein, 9 aa, Homo sapiens
RHLFPQEAF

SEQ ID NO: 5120 - protein, 9 aa, Homo sapiens
FPAHPIYDL

SEQ ID NO: 5121 - protein, 9 aa, Homo sapiens
LPPSLRCSL

SEQ ID NO: 5122 - protein, 9 aa, Homo sapiens
SYRLWGAPL

SEQ ID NO: 5123 - protein, 9 aa, Homo sapiens
VVPQASVPL

SEQ ID NO: 5124 - protein, 9 aa, Homo sapiens
VPQASVPLL

SEQ ID NO: 5125 - protein, 9 aa, Homo sapiens
WEPVLVPEA

SEQ ID NO: 5126 - protein, 9 aa, Homo sapiens
LSRTPTRQI

SEQ ID NO: 5127 - protein, 9 aa, Homo sapiens
TPTRQIGSI

SEQ ID NO: 5128 - protein, 9 aa, Homo sapiens
CCCFHGPAF

SEQ ID NO: 5129 - protein, 9 aa, Homo sapiens
PIYDLSQVW

SEQ ID NO: 5130 - protein, 9 aa, Homo sapiens
HPAQWEPVL

SEQ ID NO: 5131 - protein, 9 aa, Homo sapiens
HPNASLTMY

SEQ ID NO: 5132 - protein, 9 aa, Homo sapiens
GPMPCSRLL

SEQ ID NO: 5133 - protein, 9 aa, Homo sapiens
PCSRLLPSL

SEQ ID NO: 5134 - protein, 9 aa, Homo sapiens
LLPSLRCSL

SEQ ID NO: 5135 - protein, 9 aa, Homo sapiens
RLLPSLRCS

SEQ ID NO: 5136 - protein, 9 aa, Homo sapiens
SGDPASSRL

SEQ ID NO: 5137 - protein, 9 aa, Homo sapiens
GDPASSRLW

SEQ ID NO: 5138 - protein, 9 aa, Homo sapiens
SSRLWGAPL

SEQ ID NO: 5139 - protein, 9 aa, Homo sapiens
ASSRLWGAP

SEQ ID NO: 5140 - protein, 9 aa, Homo sapiens
PLLTDPAQW

SEQ ID NO: 5141 - protein, 9 aa, Homo sapiens
DPAQWEPVL

SEQ ID NO: 5142 - protein, 9 aa, Homo sapiens
ASVPLLTDP

SEQ ID NO: 5143 - protein, 9 aa, Homo sapiens
ASVPLLTDL

SEQ ID NO: 5144 - protein, 9 aa, Homo sapiens
PLLTDLAQW

SEQ ID NO: 5145 - protein, 9 aa, Homo sapiens
DLAQWEPVL

SEQ ID NO: 5146 - protein, 9 aa, Homo sapiens
ASVPLLTHL

SEQ ID NO: 5147 - protein, 9 aa, Homo sapiens
PLLTHLAQW

SEQ ID NO: 5148 - protein, 9 aa, Homo sapiens
HLAQWEPVL

SEQ ID NO: 5149 - protein, 9 aa, Homo sapiens
ASLTMYVCT

SEQ ID NO: 5150 - protein, 9 aa, Homo sapiens
VCTPVPHPD

SEQ ID NO: 5151 - protein, 9 aa, Homo sapiens
SLTMYVCTP

SEQ ID NO: 5152 - protein, 9 aa, Homo sapiens
TMYVCTPVP

SEQ ID NO: 5153 - protein, 9 aa, Homo sapiens
MYVCTPVPH

SEQ ID NO: 5154 - protein, 9 aa, Homo sapiens
YVCTPVPHP

SEQ ID NO: 5155 - protein, 9 aa, Homo sapiens
TPTRQISSI

SEQ ID NO: 5156 - protein, 9 aa, Homo sapiens
RQISSIDTD

SEQ ID NO: 5157 - protein, 9 aa, Homo sapiens
SRTPTRQIS

SEQ ID NO: 5158 - protein, 9 aa, Homo sapiens
SSIDTDPPA

SEQ ID NO: 5159 - protein, 9 aa, Homo sapiens
TPTRQISSS

SEQ ID NO: 5160 - protein, 9 aa, Homo sapiens
RQISSSDTD

SEQ ID NO: 5161 - protein, 9 aa, Homo sapiens
SSSDTDPPA

SEQ ID NO: 5162 - protein, 9 aa, Homo sapiens
ISSSDTDPP

SEQ ID NO: 5163 - protein, 9 aa, Homo sapiens
PTRQISSSD

SEQ ID NO: 5164 - protein, 9 aa, Homo sapiens
QISSSDTDP

SEQ ID NO: 5165 - protein, 9 aa, Homo sapiens
SSDTDPPAD

SEQ ID NO: 5166 - protein, 9 aa, Homo sapiens
RQIGSSDTD

SEQ ID NO: 5167 - protein, 9 aa, Homo sapiens
TPTRQIGSS

SEQ ID NO: 5168 - protein, 9 aa, Homo sapiens
SDTDPPADG

SEQ ID NO: 5169 - protein, 9 aa, Homo sapiens
IGSSDTDPP

SEQ ID NO: 5170 - protein, 9 aa, Homo sapiens
RGQALRRAQ

SEQ ID NO: 5171 - protein, 9 aa, Homo sapiens
SRGQALRRA

SEQ ID NO: 5172 - protein, 9 aa, Homo sapiens
GPMPCSRLL

SEQ ID NO: 5173 - protein, 9 aa, Homo sapiens
MPCSRLLPS

SEQ ID NO: 5174 - protein, 9 aa, Homo sapiens
LPSLRCSLH

SEQ ID NO: 5175 - protein, 9 aa, Homo sapiens
LLPSLRCSL

SEQ ID NO: 5176 - protein, 9 aa, Homo sapiens
RAVGLLTVI

SEQ ID NO: 5177 - protein, 9 aa, Homo sapiens
HALQPAAAI

SEQ ID NO: 5178 - protein, 9 aa, Homo sapiens
LALLPALGL

SEQ ID NO: 5179 - protein, 9 aa, Homo sapiens
LALQPGTAL

SEQ ID NO: 5180 - protein, 9 aa, Homo sapiens
TARIRAVGL

SEQ ID NO: 5181 - protein, 9 aa, Homo sapiens
DYYVGKKNI

SEQ ID NO: 5182 - protein, 9 aa, Homo sapiens
QPAAAILAL

SEQ ID NO: 5183 - protein, 9 aa, Homo sapiens
PAAAILALL

SEQ ID NO: 5184 - protein, 9 aa, Homo sapiens
LALLMAGLA

SEQ ID NO: 5185 - protein, 9 aa, Homo sapiens
PALGLLLWG

SEQ ID NO: 5186 - protein, 9 aa, Homo sapiens
LCYSCKAQV

SEQ ID NO: 5187 - protein, 9 aa, Homo sapiens
IRAVGLLTV

SEQ ID NO: 5188 - protein, 9 aa, Homo sapiens
LPALGLLLW

SEQ ID NO: 5189 - protein, 9 aa, Homo sapiens
QPGTALLCY

SEQ ID NO: 5190 - protein, 9 aa, Homo sapiens
TALLCYSCK

SEQ ID NO: 5191 - protein, 9 aa, Homo sapiens
VGLLTVISK

SEQ ID NO: 5192 - protein, 9 aa, Homo sapiens
KAVLLALLM

SEQ ID NO: 5193 - protein, 9 aa, Homo sapiens
MAGLALQPG

SEQ ID NO: 5194 - protein, 9 aa, Homo sapiens
KAQVSNEDC

SEQ ID NO: 5195 - protein, 9 aa, Homo sapiens
VSNEDCLQV

SEQ ID NO: 5196 - protein, 9 aa, Homo sapiens
NASGAHALQ

SEQ ID NO: 5197 - protein, 9 aa, Homo sapiens
AAAILALLP

SEQ ID NO: 5198 - protein, 9 aa, Homo sapiens
AAILALLPA

SEQ ID NO: 5199 - protein, 9 aa, Homo sapiens
DPASSRLWG

SEQ ID NO: 5200 - protein, 9 aa, Homo sapiens
SGDPASSRL

SEQ ID NO: 5201 - protein, 9 aa, Homo sapiens
PASSRLWGA

SEQ ID NO: 5202 - protein, 9 aa, Homo sapiens
DPAQWEPVL

SEQ ID NO: 5203 - protein, 9 aa, Homo sapiens
QASVPLLTD

SEQ ID NO: 5204 - protein, 9 aa, Homo sapiens
VPLLTDPAQ

SEQ ID NO: 5205 - protein, 9 aa, Homo sapiens
TDPAQWEPV

SEQ ID NO: 5206 - protein, 9 aa, Homo sapiens
VPLLTDLAQ

SEQ ID NO: 5207 - protein, 9 aa, Homo sapiens
DLAQWEPVL

SEQ ID NO: 5208 - protein, 9 aa, Homo sapiens
TDLAQWEPV

SEQ ID NO: 5209 - protein, 9 aa, Homo sapiens
ASVPLLTDL

SEQ ID NO: 5210 - protein, 9 aa, Homo sapiens
LAQWEPVLV

SEQ ID NO: 5211 - protein, 9 aa, Homo sapiens
VPLLTHLAQ

SEQ ID NO: 5212 - protein, 9 aa, Homo sapiens
THLAQWEPV

SEQ ID NO: 5213 - protein, 9 aa, Homo sapiens
LTMYVCTPV

SEQ ID NO: 5214 - protein, 9 aa, Homo sapiens
TMYVCTPVP

SEQ ID NO: 5215 - protein, 9 aa, Homo sapiens
YVCTPVPHP

SEQ ID NO: 5216 - protein, 9 aa, Homo sapiens
TPTRQISSI

SEQ ID NO: 5217 - protein, 9 aa, Homo sapiens
TPTRQISSS

SEQ ID NO: 5218 - protein, 9 aa, Homo sapiens
TPTRQIGSS

SEQ ID NO: 5219 - protein, 9 aa, Homo sapiens
IGSSDTDPP

SEQ ID NO: 5220 - protein, 9 aa, Homo sapiens
RGQALRRAQ

SEQ ID NO: 5221 - protein, 9 aa, Homo sapiens
SRGQALRRA

SEQ ID NO: 5222 - protein, 10 aa, Homo sapiens
LQPGTALLCY

SEQ ID NO: 5223 - protein, 10 aa, Homo sapiens
QVENCTQLGE

SEQ ID NO: 5224 - protein, 10 aa, Homo sapiens
DTDLCNASGA

SEQ ID NO: 5225 - protein, 10 aa, Homo sapiens
LNCVDDSQDY

SEQ ID NO: 5226 - protein, 10 aa, Homo sapiens
NCVDDSQDYY

SEQ ID NO: 5227 - protein, 10 aa, Homo sapiens
SQDYYVGKKN

SEQ ID NO: 5228 - protein, 10 aa, Homo sapiens
ALLPALGLLL

SEQ ID NO: 5229 - protein, 10 aa, Homo sapiens
ALQPGTALLC

SEQ ID NO: 5230 - protein, 10 aa, Homo sapiens
SNEDCLQVEN

SEQ ID NO: 5231 - protein, 10 aa, Homo sapiens
VDDSQDYYVG

SEQ ID NO: 5232 - protein, 10 aa, Homo sapiens
ITCCDTDLCN

SEQ ID NO: 5233 - protein, 10 aa, Homo sapiens
ALQPAAAILA

SEQ ID NO: 5234 - protein, 10 aa, Homo sapiens
NEDCLQVENC

SEQ ID NO: 5235 - protein, 10 aa, Homo sapiens
LGEQCWTARI

SEQ ID NO: 5236 - protein, 10 aa, Homo sapiens
ARIRAVGLLT

SEQ ID NO: 5237 - protein, 10 aa, Homo sapiens
CVDDSQDYYV

SEQ ID NO: 5238 - protein, 10 aa, Homo sapiens
CCDTDLCNAS

SEQ ID NO: 5239 - protein, 10 aa, Homo sapiens
HPDPPMALSR

SEQ ID NO: 5240 - protein, 10 aa, Homo sapiens
DTDPPADGPS

SEQ ID NO: 5241 - protein, 10 aa, Homo sapiens
SGDPASYRLW

SEQ ID NO: 5242 - protein, 10 aa, Homo sapiens
AHPNASLTMY

SEQ ID NO: 5243 - protein, 10 aa, Homo sapiens
ACCSGDPASY

SEQ ID NO: 5244 - protein, 10 aa, Homo sapiens
QWEPVLVPEA

SEQ ID NO: 5245 - protein, 10 aa, Homo sapiens
QEAFPAHPIY

SEQ ID NO: 5246 - protein, 10 aa, Homo sapiens
PADGPSNPLC

SEQ ID NO: 5247 - protein, 10 aa, Homo sapiens
VPEAHPNASL

SEQ ID NO: 5248 - protein, 10 aa, Homo sapiens
SIDTDPPADG

SEQ ID NO: 5249 - protein, 10 aa, Homo sapiens
FSTLNPVLRH

SEQ ID NO: 5250 - protein, 10 aa, Homo sapiens
GPMPCSRLPP

SEQ ID NO: 5251 - protein, 10 aa, Homo sapiens
ADGPSNPLCC

SEQ ID NO: 5252 - protein, 10 aa, Homo sapiens
IYDLSQVWSV

SEQ ID NO: 5253 - protein, 10 aa, Homo sapiens
CSRLPPSLRC

SEQ ID NO: 5254 - protein, 10 aa, Homo sapiens
LTHPAQWEPV

SEQ ID NO: 5255 - protein, 10 aa, Homo sapiens
EAHPNASLTM

SEQ ID NO: 5256 - protein, 10 aa, Homo sapiens
SRTPTRQIGS

SEQ ID NO: 5257 - protein, 10 aa, Homo sapiens
PTRQIGSIDT

SEQ ID NO: 5258 - protein, 10 aa, Homo sapiens
PQEAFPAHPI

SEQ ID NO: 5259 - protein, 10 aa, Homo sapiens
PAHPIYDLSQ

SEQ ID NO: 5260 - protein, 10 aa, Homo sapiens
VPQASVPLLT

SEQ ID NO: 5261 - protein, 10 aa, Homo sapiens
ASVPLLTHPA

SEQ ID NO: 5262 - protein, 10 aa, Homo sapiens
GPMPCSRLLP

SEQ ID NO: 5263 - protein, 10 aa, Homo sapiens
CSRLLPSLRC

SEQ ID NO: 5264 - protein, 10 aa, Homo sapiens
PMPCSRLLPS

SEQ ID NO: 5265 - protein, 10 aa, Homo sapiens
RLLPSLRCSL

SEQ ID NO: 5266 - protein, 10 aa, Homo sapiens
LPSLRCSLHS

SEQ ID NO: 5267 - protein, 10 aa, Homo sapiens
SGDPASSRLW

SEQ ID NO: 5268 - protein, 10 aa, Homo sapiens
SSRLWGAPLQ

SEQ ID NO: 5269 - protein, 10 aa, Homo sapiens
SRLWGAPLQP

SEQ ID NO: 5270 - protein, 10 aa, Homo sapiens
LTDPAQWEPV

SEQ ID NO: 5271 - protein, 10 aa, Homo sapiens
ASVPLLTDPA

SEQ ID NO: 5272 - protein, 10 aa, Homo sapiens
LTDLAQWEPV

SEQ ID NO: 5273 - protein, 10 aa, Homo sapiens
ASVPLLTDLA

SEQ ID NO: 5274 - protein, 10 aa, Homo sapiens
SVPLLTDLAQ

SEQ ID NO: 5275 - protein, 10 aa, Homo sapiens
ASVPLLTHLA

SEQ ID NO: 5276 - protein, 10 aa, Homo sapiens
SVPLLTHLAQ

SEQ ID NO: 5277 - protein, 10 aa, Homo sapiens
LAQWEPVLVP

SEQ ID NO: 5278 - protein, 10 aa, Homo sapiens
LTHLAQWEPV

SEQ ID NO: 5279 - protein, 10 aa, Homo sapiens
LTMYVCTPVP

SEQ ID NO: 5280 - protein, 10 aa, Homo sapiens
ASLTMYVCTP

SEQ ID NO: 5281 - protein, 10 aa, Homo sapiens
CTPVPHPDPP

SEQ ID NO: 5282 - protein, 10 aa, Homo sapiens
VCTPVPHPDP

SEQ ID NO: 5283 - protein, 10 aa, Homo sapiens
TPVPHPDPPM

SEQ ID NO: 5284 - protein, 10 aa, Homo sapiens
SLTMYVCTPV

SEQ ID NO: 5285 - protein, 10 aa, Homo sapiens
SRTPTRQISS

SEQ ID NO: 5286 - protein, 10 aa, Homo sapiens
PTRQISSIDT

SEQ ID NO: 5287 - protein, 10 aa, Homo sapiens
RTPTRQISSI

SEQ ID NO: 5288 - protein, 10 aa, Homo sapiens
SSIDTDPPAD

SEQ ID NO: 5289 - protein, 10 aa, Homo sapiens
LSRTPTRQIS

SEQ ID NO: 5290 - protein, 10 aa, Homo sapiens
ISSIDTDPPA

SEQ ID NO: 5291 - protein, 10 aa, Homo sapiens
RTPTRQISSS

SEQ ID NO: 5292 - protein, 10 aa, Homo sapiens
PTRQISSSDT

SEQ ID NO: 5293 - protein, 10 aa, Homo sapiens
SSSDTDPPAD

SEQ ID NO: 5294 - protein, 10 aa, Homo sapiens
ISSSDTDPPA

SEQ ID NO: 5295 - protein, 10 aa, Homo sapiens
SSDTDPPADG

SEQ ID NO: 5296 - protein, 10 aa, Homo sapiens
PSRGQALRRA

SEQ ID NO: 5297 - protein, 10 aa, Homo sapiens
SRGQALRRAQ

SEQ ID NO: 5298 - protein, 10 aa, Homo sapiens
ALLPALGLLL

SEQ ID NO: 5299 - protein, 10 aa, Homo sapiens
VLLALLMAGL

SEQ ID NO: 5300 - protein, 10 aa, Homo sapiens
ILALLPALGL

SEQ ID NO: 5301 - protein, 10 aa, Homo sapiens
RIRAVGLLTV

SEQ ID NO: 5302 - protein, 10 aa, Homo sapiens
GLALQPGTAL

SEQ ID NO: 5303 - protein, 10 aa, Homo sapiens
AAILALLPAL

SEQ ID NO: 5304 - protein, 10 aa, Homo sapiens
LLCYSCKAQV

SEQ ID NO: 5305 - protein, 10 aa, Homo sapiens
GLLLWGPGQL

SEQ ID NO: 5306 - protein, 10 aa, Homo sapiens
LALLPALGLL

SEQ ID NO: 5307 - protein, 10 aa, Homo sapiens
LALLMAGLAL

SEQ ID NO: 5308 - protein, 10 aa, Homo sapiens
ALLMAGLALQ

SEQ ID NO: 5309 - protein, 10 aa, Homo sapiens
LALQPGTALL

SEQ ID NO: 5310 - protein, 10 aa, Homo sapiens
CLQVENCTQL

SEQ ID NO: 5311 - protein, 10 aa, Homo sapiens
WTARIRAVGL

SEQ ID NO: 5312 - protein, 10 aa, Homo sapiens
LLALLMAGLA

SEQ ID NO: 5313 - protein, 10 aa, Homo sapiens
LMAGLALQPG

SEQ ID NO: 5314 - protein, 10 aa, Homo sapiens
TARIRAVGLL

SEQ ID NO: 5315 - protein, 10 aa, Homo sapiens
LTVISKGCSL

SEQ ID NO: 5316 - protein, 10 aa, Homo sapiens
ISKGCSLNCV

SEQ ID NO: 5317 - protein, 10 aa, Homo sapiens
HALQPAAAIL

SEQ ID NO: 5318 - protein, 10 aa, Homo sapiens
ALQPAAAILA

SEQ ID NO: 5319 - protein, 10 aa, Homo sapiens
LQPAAAILAL

SEQ ID NO: 5320 - protein, 10 aa, Homo sapiens
QPAAAILALL

SEQ ID NO: 5321 - protein, 10 aa, Homo sapiens
AAAILALLPA

SEQ ID NO: 5322 - protein, 10 aa, Homo sapiens
LLPALGLLLW

SEQ ID NO: 5323 - protein, 10 aa, Homo sapiens
QCWTARIRAV

SEQ ID NO: 5324 - protein, 10 aa, Homo sapiens
IRAVGLLTVI

SEQ ID NO: 5325 - protein, 10 aa, Homo sapiens
CVDDSQDYYV

SEQ ID NO: 5326 - protein, 10 aa, Homo sapiens
ALQPGTALLC

SEQ ID NO: 5327 - protein, 10 aa, Homo sapiens
KAQVSNEDCL

SEQ ID NO: 5328 - protein, 10 aa, Homo sapiens
QVSNEDCLQV

SEQ ID NO: 5329 - protein, 10 aa, Homo sapiens
DLCNASGAHA

SEQ ID NO: 5330 - protein, 10 aa, Homo sapiens
LCNASGAHAL

SEQ ID NO: 5331 - protein, 10 aa, Homo sapiens
AHALQPAAAI

SEQ ID NO: 5332 - protein, 10 aa, Homo sapiens
KAVLLALLMA

SEQ ID NO: 5333 - protein, 10 aa, Homo sapiens
LLMAGLALQP

SEQ ID NO: 5334 - protein, 10 aa, Homo sapiens
ALLCYSCKAQ

SEQ ID NO: 5335 - protein, 10 aa, Homo sapiens
AILALLPALG

SEQ ID NO: 5336 - protein, 10 aa, Homo sapiens
AVLLALLMAG

SEQ ID NO: 5337 - protein, 10 aa, Homo sapiens
QLGEQCWTAR

SEQ ID NO: 5338 - protein, 10 aa, Homo sapiens
GLLTVISKGC

SEQ ID NO: 5339 - protein, 10 aa, Homo sapiens
SLNCVDDSQD

SEQ ID NO: 5340 - protein, 10 aa, Homo sapiens
KNITCCDTDL

SEQ ID NO: 5341 - protein, 10 aa, Homo sapiens
RLPPSLRCSL

SEQ ID NO: 5342 - protein, 10 aa, Homo sapiens
TLGVVPQASV

SEQ ID NO: 5343 - protein, 10 aa, Homo sapiens
SLTMYVCAPV

SEQ ID NO: 5344 - protein, 10 aa, Homo sapiens
STLNPVLRHL

SEQ ID NO: 5345 - protein, 10 aa, Homo sapiens
RLWGAPLQPT

SEQ ID NO: 5346 - protein, 10 aa, Homo sapiens
VVPQASVPLL

SEQ ID NO: 5347 - protein, 10 aa, Homo sapiens
ALSRTPTRQI

SEQ ID NO: 5348 - protein, 10 aa, Homo sapiens
GVVPQASVPL

SEQ ID NO: 5349 - protein, 10 aa, Homo sapiens
APLQPTLGVV

SEQ ID NO: 5350 - protein, 10 aa, Homo sapiens
LTHPAQWEPV

SEQ ID NO: 5351 - protein, 10 aa, Homo sapiens
VLVPEAHPNA

SEQ ID NO: 5352 - protein, 10 aa, Homo sapiens
RTPTRQIGSI

SEQ ID NO: 5353 - protein, 10 aa, Homo sapiens
IYDLSQVWSV

SEQ ID NO: 5354 - protein, 10 aa, Homo sapiens
GAPLQPTLGV

SEQ ID NO: 5355 - protein, 10 aa, Homo sapiens
GPAFSTLNPV

SEQ ID NO: 5356 - protein, 10 aa, Homo sapiens
VLRHLFPQEA

SEQ ID NO: 5357 - protein, 10 aa, Homo sapiens
HLFPQEAFPA

SEQ ID NO: 5358 - protein, 10 aa, Homo sapiens
AFPAHPIYDL

SEQ ID NO: 5359 - protein, 10 aa, Homo sapiens
SPAPSRGQAL

SEQ ID NO: 5360 - protein, 10 aa, Homo sapiens
AHPIYDLSQV

SEQ ID NO: 5361 - protein, 10 aa, Homo sapiens
ASYRLWGAPL

SEQ ID NO: 5362 - protein, 10 aa, Homo sapiens
LWGAPLQPTL

SEQ ID NO: 5363 - protein, 10 aa, Homo sapiens
HPAQWEPVLV

SEQ ID NO: 5364 - protein, 10 aa, Homo sapiens
VPEAHPNASL

SEQ ID NO: 5365 - protein, 10 aa, Homo sapiens
VPHPDPPMAL

SEQ ID NO: 5366 - protein, 10 aa, Homo sapiens
CFHGPAFSTL

SEQ ID NO: 5367 - protein, 10 aa, Homo sapiens
TLNPVLRHLF

SEQ ID NO: 5368 - protein, 10 aa, Homo sapiens
YDLSQVWSVV

SEQ ID NO: 5369 - protein, 10 aa, Homo sapiens
TWARRTSRAV

SEQ ID NO: 5370 - protein, 10 aa, Homo sapiens
PAGPMPCSRL

SEQ ID NO: 5371 - protein, 10 aa, Homo sapiens
MPCSRLPPSL

SEQ ID NO: 5372 - protein, 10 aa, Homo sapiens
SLRCSLHSAC

SEQ ID NO: 5373 - protein, 10 aa, Homo sapiens
SLHSACCSGD

SEQ ID NO: 5374 - protein, 10 aa, Homo sapiens
LLTHPAQWEP

SEQ ID NO: 5375 - protein, 10 aa, Homo sapiens
PAFSTLNPVL

SEQ ID NO: 5376 - protein, 10 aa, Homo sapiens
CSGDPASYRL

SEQ ID NO: 5377 - protein, 10 aa, Homo sapiens
QWEPVLVPEA

SEQ ID NO: 5378 - protein, 10 aa, Homo sapiens
SIDTDPPADG

SEQ ID NO: 5379 - protein, 10 aa, Homo sapiens
AVTPTCATPA

SEQ ID NO: 5380 - protein, 10 aa, Homo sapiens
PLQPTLGVVP

SEQ ID NO: 5381 - protein, 10 aa, Homo sapiens
THPAQWEPVL

SEQ ID NO: 5382 - protein, 10 aa, Homo sapiens
AQWEPVLVPE

SEQ ID NO: 5383 - protein, 10 aa, Homo sapiens
HPNASLTMYV

SEQ ID NO: 5384 - protein, 10 aa, Homo sapiens
TMYVCAPVPH

SEQ ID NO: 5385 - protein, 10 aa, Homo sapiens
PPADGPSNPL

SEQ ID NO: 5386 - protein, 10 aa, Homo sapiens
PLCCCFHGPA

SEQ ID NO: 5387 - protein, 10 aa, Homo sapiens
DLSQVWSVVS

SEQ ID NO: 5388 - protein, 10 aa, Homo sapiens
RLLPSLRCSL

SEQ ID NO: 5389 - protein, 10 aa, Homo sapiens
MPCSRLLPSL

SEQ ID NO: 5390 - protein, 10 aa, Homo sapiens
AGPMPCSRLL

SEQ ID NO: 5391 - protein, 10 aa, Homo sapiens
LLPSLRCSLH

SEQ ID NO: 5392 - protein, 10 aa, Homo sapiens
ASSRLWGAPL

SEQ ID NO: 5393 - protein, 10 aa, Homo sapiens
CSGDPASSRL

SEQ ID NO: 5394 - protein, 10 aa, Homo sapiens
DPASSRLWGA

SEQ ID NO: 5395 - protein, 10 aa, Homo sapiens
ACCSGDPASS

SEQ ID NO: 5396 - protein, 10 aa, Homo sapiens
LTDPAQWEPV

SEQ ID NO: 5397 - protein, 10 aa, Homo sapiens
LLTDPAQWEP

SEQ ID NO: 5398 - protein, 10 aa, Homo sapiens
DPAQWEPVLV

SEQ ID NO: 5399 - protein, 10 aa, Homo sapiens
TDPAQWEPVL

SEQ ID NO: 5400 - protein, 10 aa, Homo sapiens
PLLTDPAQWE

SEQ ID NO: 5401 - protein, 10 aa, Homo sapiens
QASVPLLTDP

SEQ ID NO: 5402 - protein, 10 aa, Homo sapiens
ASVPLLTDPA

SEQ ID NO: 5403 - protein, 10 aa, Homo sapiens
SVPLLTDPAQ

SEQ ID NO: 5404 - protein, 10 aa, Homo sapiens
DLAQWEPVLV

SEQ ID NO: 5405 - protein, 10 aa, Homo sapiens
QASVPLLTDL

SEQ ID NO: 5406 - protein, 10 aa, Homo sapiens
LTDLAQWEPV

SEQ ID NO: 5407 - protein, 10 aa, Homo sapiens
LLTDLAQWEP

SEQ ID NO: 5408 - protein, 10 aa, Homo sapiens
TDLAQWEPVL

SEQ ID NO: 5409 - protein, 10 aa, Homo sapiens
HLAQWEPVLV

SEQ ID NO: 5410 - protein, 10 aa, Homo sapiens
QASVPLLTHL

SEQ ID NO: 5411 - protein, 10 aa, Homo sapiens
LTHLAQWEPV

SEQ ID NO: 5412 - protein, 10 aa, Homo sapiens
LLTHLAQWEP

SEQ ID NO: 5413 - protein, 10 aa, Homo sapiens
THLAQWEPVL

SEQ ID NO: 5414 - protein, 10 aa, Homo sapiens
LAQWEPVLVP

SEQ ID NO: 5415 - protein, 10 aa, Homo sapiens
SLTMYVCTPV

SEQ ID NO: 5416 - protein, 10 aa, Homo sapiens
TMYVCTPVPH

SEQ ID NO: 5417 - protein, 10 aa, Homo sapiens
NASLTMYVCT

SEQ ID NO: 5418 - protein, 10 aa, Homo sapiens
ASLTMYVCTP

SEQ ID NO: 5419 - protein, 10 aa, Homo sapiens
RTPTRQISSI

SEQ ID NO: 5420 - protein, 10 aa, Homo sapiens
QISSIDTDPP

SEQ ID NO: 5421 - protein, 10 aa, Homo sapiens
RTPTRQISSS

SEQ ID NO: 5422 - protein, 10 aa, Homo sapiens
QISSSDTDPP

SEQ ID NO: 5423 - protein, 10 aa, Homo sapiens
ISSSDTDPPA

SEQ ID NO: 5424 - protein, 10 aa, Homo sapiens
PTRQISSSDT

SEQ ID NO: 5425 - protein, 10 aa, Homo sapiens
SSSDTDPPAD

SEQ ID NO: 5426 - protein, 10 aa, Homo sapiens
RTPTRQIGSS

SEQ ID NO: 5427 - protein, 10 aa, Homo sapiens
QIGSSDTDPP

SEQ ID NO: 5428 - protein, 10 aa, Homo sapiens
IGSSDTDPPA

SEQ ID NO: 5429 - protein, 10 aa, Homo sapiens
PTRQIGSSDT

SEQ ID NO: 5430 - protein, 10 aa, Homo sapiens
RQIGSSDTDP

SEQ ID NO: 5431 - protein, 10 aa, Homo sapiens
GSSDTDPPAD

SEQ ID NO: 5432 - protein, 10 aa, Homo sapiens
SSDTDPPADG

SEQ ID NO: 5433 - protein, 10 aa, Homo sapiens
PSRGQALRRA

SEQ ID NO: 5434 - protein, 10 aa, Homo sapiens
SRGQALRRAQ

SEQ ID NO: 5435 - protein, 10 aa, Homo sapiens
GAHALQPAAA

SEQ ID NO: 5436 - protein, 10 aa, Homo sapiens
SGAHALQPAA

SEQ ID NO: 5437 - protein, 10 aa, Homo sapiens
DLCNASGAHA

SEQ ID NO: 5438 - protein, 10 aa, Homo sapiens
AHALQPAAAI

SEQ ID NO: 5439 - protein, 10 aa, Homo sapiens
TTWARRTSRA

SEQ ID NO: 5440 - protein, 10 aa, Homo sapiens
TSRAVTPTCA

SEQ ID NO: 5441 - protein, 10 aa, Homo sapiens
AVTPTCATPA

SEQ ID NO: 5442 - protein, 10 aa, Homo sapiens
PSLRCSLHSA

SEQ ID NO: 5443 - protein, 10 aa, Homo sapiens
HSACCSGDPA

SEQ ID NO: 5444 - protein, 10 aa, Homo sapiens
DPASYRLWGA

SEQ ID NO: 5445 - protein, 10 aa, Homo sapiens
QPTLGVVPQA

SEQ ID NO: 5446 - protein, 10 aa, Homo sapiens
ASVPLLTHPA

SEQ ID NO: 5447 - protein, 10 aa, Homo sapiens
QWEPVLVPEA

SEQ ID NO: 5448 - protein, 10 aa, Homo sapiens
VLVPEAHPNA

SEQ ID NO: 5449 - protein, 10 aa, Homo sapiens
NASLTMYVCA

SEQ ID NO: 5450 - protein, 10 aa, Homo sapiens
PVPHPDPPMA

SEQ ID NO: 5451 - protein, 10 aa, Homo sapiens
IGSIDTDPPA

SEQ ID NO: 5452 - protein, 10 aa, Homo sapiens
PLCCCFHGPA

SEQ ID NO: 5453 - protein, 10 aa, Homo sapiens
VLRHLFPQEA

SEQ ID NO: 5454 - protein, 10 aa, Homo sapiens
HLFPQEAFPA

SEQ ID NO: 5455 - protein, 10 aa, Homo sapiens
SQVWSVVSPA

SEQ ID NO: 5456 - protein, 10 aa, Homo sapiens
VSPAPSRGQA

SEQ ID NO: 5457 - protein, 10 aa, Homo sapiens
PSRGQALRRA

SEQ ID NO: 5458 - protein, 10 aa, Homo sapiens
MTHRTTTWAR

SEQ ID NO: 5459 - protein, 10 aa, Homo sapiens
TWARRTSRAV

SEQ ID NO: 5460 - protein, 10 aa, Homo sapiens
SRAVTPTCAT

SEQ ID NO: 5461 - protein, 10 aa, Homo sapiens
VTPTCATPAG

SEQ ID NO: 5462 - protein, 10 aa, Homo sapiens
SLRCSLHSAC

SEQ ID NO: 5463 - protein, 10 aa, Homo sapiens
SACCSGDPAS

SEQ ID NO: 5464 - protein, 10 aa, Homo sapiens
PASYRLWGAP

SEQ ID NO: 5465 - protein, 10 aa, Homo sapiens
PTLGVVPQAS

SEQ ID NO: 5466 - protein, 10 aa, Homo sapiens
SVPLLTHPAQ

SEQ ID NO: 5467 - protein, 10 aa, Homo sapiens
WEPVLVPEAH

SEQ ID NO: 5468 - protein, 10 aa, Homo sapiens
LVPEAHPNAS

SEQ ID NO: 5469 - protein, 10 aa, Homo sapiens
ASLTMYVCAP

SEQ ID NO: 5470 - protein, 10 aa, Homo sapiens
VPHPDPPMAL

SEQ ID NO: 5471 - protein, 10 aa, Homo sapiens
GSIDTDPPAD

SEQ ID NO: 5472 - protein, 10 aa, Homo sapiens
LCCCFHGPAF

SEQ ID NO: 5473 - protein, 10 aa, Homo sapiens
LRHLFPQEAF

SEQ ID NO: 5474 - protein, 10 aa, Homo sapiens
LFPQEAFPAH

SEQ ID NO: 5475 - protein, 10 aa, Homo sapiens
QVWSVVSPAP

SEQ ID NO: 5476 - protein, 10 aa, Homo sapiens
SPAPSRGQAL

SEQ ID NO: 5477 - protein, 10 aa, Homo sapiens
SRGQALRRAR

SEQ ID NO: 5478 - protein, 10 aa, Homo sapiens
THRTTTWARR

SEQ ID NO: 5479 - protein, 10 aa, Homo sapiens
WARRTSRAVT

SEQ ID NO: 5480 - protein, 10 aa, Homo sapiens
RAVTPTCATP

SEQ ID NO: 5481 - protein, 10 aa, Homo sapiens
TPTCATPAGP

SEQ ID NO: 5482 - protein, 10 aa, Homo sapiens
LRCSLHSACC

SEQ ID NO: 5483 - protein, 10 aa, Homo sapiens
ACCSGDPASY

SEQ ID NO: 5484 - protein, 10 aa, Homo sapiens
ASYRLWGAPL

SEQ ID NO: 5485 - protein, 10 aa, Homo sapiens
TLGVVPQASV

SEQ ID NO: 5486 - protein, 10 aa, Homo sapiens
VPLLTHPAQW

SEQ ID NO: 5487 - protein, 10 aa, Homo sapiens
EPVLVPEAHP

SEQ ID NO: 5488 - protein, 10 aa, Homo sapiens
VPEAHPNASL

SEQ ID NO: 5489 - protein, 10 aa, Homo sapiens
SLTMYVCAPV

SEQ ID NO: 5490 - protein, 10 aa, Homo sapiens
PHPDPPMALS

SEQ ID NO: 5491 - protein, 10 aa, Homo sapiens
SIDTDPPADG

SEQ ID NO: 5492 - protein, 10 aa, Homo sapiens
CCCFHGPAFS

SEQ ID NO: 5493 - protein, 10 aa, Homo sapiens
RHLFPQEAFP

SEQ ID NO: 5494 - protein, 10 aa, Homo sapiens
FPQEAFPAHP

SEQ ID NO: 5495 - protein, 10 aa, Homo sapiens
VWSVVSPAPS

SEQ ID NO: 5496 - protein, 10 aa, Homo sapiens
PAPSRGQALR

SEQ ID NO: 5497 - protein, 10 aa, Homo sapiens
DPASSRLWGA

SEQ ID NO: 5498 - protein, 10 aa, Homo sapiens
PASSRLWGAP

SEQ ID NO: 5499 - protein, 10 aa, Homo sapiens
ACCSGDPASS

SEQ ID NO: 5500 - protein, 10 aa, Homo sapiens
ASSRLWGAPL

SEQ ID NO: 5501 - protein, 10 aa, Homo sapiens
ASVPLLTDPA

SEQ ID NO: 5502 - protein, 10 aa, Homo sapiens
SVPLLTDPAQ

SEQ ID NO: 5503 - protein, 10 aa, Homo sapiens
VPLLTDPAQW

SEQ ID NO: 5504 - protein, 10 aa, Homo sapiens
ASVPLLTDLA

SEQ ID NO: 5505 - protein, 10 aa, Homo sapiens
SVPLLTDLAQ

SEQ ID NO: 5506 - protein, 10 aa, Homo sapiens
VPLLTDLAQW

SEQ ID NO: 5507 - protein, 10 aa, Homo sapiens
ASVPLLTHLA

SEQ ID NO: 5508 - protein, 10 aa, Homo sapiens
SVPLLTHLAQ

SEQ ID NO: 5509 - protein, 10 aa, Homo sapiens
VPLLTHLAQW

SEQ ID NO: 5510 - protein, 10 aa, Homo sapiens
ISSIDTDPPA

SEQ ID NO: 5511 - protein, 10 aa, Homo sapiens
SSIDTDPPAD

SEQ ID NO: 5512 - protein, 10 aa, Homo sapiens
ISSSDTDPPA

SEQ ID NO: 5513 - protein, 10 aa, Homo sapiens
SSSDTDPPAD

SEQ ID NO: 5514 - protein, 10 aa, Homo sapiens
IGSSDTDPPA

SEQ ID NO: 5515 - protein, 10 aa, Homo sapiens
GSSDTDPPAD

SEQ ID NO: 5516 - protein, 10 aa, Homo sapiens
SSDTDPPADG

SEQ ID NO: 5517 - protein, 10 aa, Homo sapiens
PSRGQALRRA

SEQ ID NO: 5518 - protein, 10 aa, Homo sapiens
SRGQALRRAQ

SEQ ID NO: 5519 - protein, 10 aa, Homo sapiens
AVGLLTVISK

SEQ ID NO: 5520 - protein, 10 aa, Homo sapiens
RIRAVGLLTV

SEQ ID NO: 5521 - protein, 10 aa, Homo sapiens
ALLPALGLLL

SEQ ID NO: 5522 - protein, 10 aa, Homo sapiens
ALQPGTALLC

SEQ ID NO: 5523 - protein, 10 aa, Homo sapiens
LLMAGLALQP

SEQ ID NO: 5524 - protein, 10 aa, Homo sapiens
ILALLPALGL

SEQ ID NO: 5525 - protein, 10 aa, Homo sapiens
QVSNEDCLQV

SEQ ID NO: 5526 - protein, 10 aa, Homo sapiens
QLGEQCWTAR

SEQ ID NO: 5527 - protein, 10 aa, Homo sapiens
ALQPAAAILA

SEQ ID NO: 5528 - protein, 10 aa, Homo sapiens
AILALLPALG

SEQ ID NO: 5529 - protein, 10 aa, Homo sapiens
AVLLALLMAG

SEQ ID NO: 5530 - protein, 10 aa, Homo sapiens
ALLMAGLALQ

SEQ ID NO: 5531 - protein, 10 aa, Homo sapiens
GLLLWGPGQL

SEQ ID NO: 5532 - protein, 10 aa, Homo sapiens
VLLALLMAGL

SEQ ID NO: 5533 - protein, 10 aa, Homo sapiens
GLALQPGTAL

SEQ ID NO: 5534 - protein, 10 aa, Homo sapiens
SLNCVDDSQD

SEQ ID NO: 5535 - protein, 10 aa, Homo sapiens
DLCNASGAHA

SEQ ID NO: 5536 - protein, 10 aa, Homo sapiens
LLALLMAGLA

SEQ ID NO: 5537 - protein, 10 aa, Homo sapiens
ALLCYSCKAQ

SEQ ID NO: 5538 - protein, 10 aa, Homo sapiens
LLCYSCKAQV

SEQ ID NO: 5539 - protein, 10 aa, Homo sapiens
QVENCTQLGE

SEQ ID NO: 5540 - protein, 10 aa, Homo sapiens
TVISKGCSLN

SEQ ID NO: 5541 - protein, 10 aa, Homo sapiens
GTALLCYSCK

SEQ ID NO: 5542 - protein, 10 aa, Homo sapiens
ARIRAVGLLT

SEQ ID NO: 5543 - protein, 10 aa, Homo sapiens
LLPALGLLLW

SEQ ID NO: 5544 - protein, 10 aa, Homo sapiens
ALGLLLWGPG

SEQ ID NO: 5545 - protein, 10 aa, Homo sapiens
CLQVENCTQL

SEQ ID NO: 5546 - protein, 10 aa, Homo sapiens
DDSQDYYVGK

SEQ ID NO: 5547 - protein, 10 aa, Homo sapiens
AGLALQPGTA

SEQ ID NO: 5548 - protein, 10 aa, Homo sapiens
GLLTVISKGC

SEQ ID NO: 5549 - protein, 10 aa, Homo sapiens
DSQDYYVGKK

SEQ ID NO: 5550 - protein, 10 aa, Homo sapiens
AHALQPAAAI

SEQ ID NO: 5551 - protein, 10 aa, Homo sapiens
PLQPTLGVVP

SEQ ID NO: 5552 - protein, 10 aa, Homo sapiens
AVTPTCATPA

SEQ ID NO: 5553 - protein, 10 aa, Homo sapiens
RLPPSLRCSL

SEQ ID NO: 5554 - protein, 10 aa, Homo sapiens
ALSRTPTRQI

SEQ ID NO: 5555 - protein, 10 aa, Homo sapiens
SLRCSLHSAC

SEQ ID NO: 5556 - protein, 10 aa, Homo sapiens
TLNPVLRHLF

SEQ ID NO: 5557 - protein, 10 aa, Homo sapiens
PVLRHLFPQE

SEQ ID NO: 5558 - protein, 10 aa, Homo sapiens
PIYDLSQVWS

SEQ ID NO: 5559 - protein, 10 aa, Homo sapiens
DLSQVWSVVS

SEQ ID NO: 5560 - protein, 10 aa, Homo sapiens
ARRTSRAVTP

SEQ ID NO: 5561 - protein, 10 aa, Homo sapiens
GVVPQASVPL

SEQ ID NO: 5562 - protein, 10 aa, Homo sapiens
ASYRLWGAPL

SEQ ID NO: 5563 - protein, 10 aa, Homo sapiens
RLWGAPLQPT

SEQ ID NO: 5564 - protein, 10 aa, Homo sapiens
PLLTHPAQWE

SEQ ID NO: 5565 - protein, 10 aa, Homo sapiens
HLFPQEAFPA

SEQ ID NO: 5566 - protein, 10 aa, Homo sapiens
APSRGQALRR

SEQ ID NO: 5567 - protein, 10 aa, Homo sapiens
ACCSGDPASY

SEQ ID NO: 5568 - protein, 10 aa, Homo sapiens
TLGVVPQASV

SEQ ID NO: 5569 - protein, 10 aa, Homo sapiens
PVLVPEAHPN

SEQ ID NO: 5570 - protein, 10 aa, Homo sapiens
HPDPPMALSR

SEQ ID NO: 5571 - protein, 10 aa, Homo sapiens
SVVSPAPSRG

SEQ ID NO: 5572 - protein, 10 aa, Homo sapiens
WARRTSRAVT

SEQ ID NO: 5573 - protein, 10 aa, Homo sapiens
SLHSACCSGD

SEQ ID NO: 5574 - protein, 10 aa, Homo sapiens
SLTMYVCAPV

SEQ ID NO: 5575 - protein, 10 aa, Homo sapiens
VLRHLFPQEA

SEQ ID NO: 5576 - protein, 10 aa, Homo sapiens
SVPLLTHPAQ

SEQ ID NO: 5577 - protein, 10 aa, Homo sapiens
VLVPEAHPNA

SEQ ID NO: 5578 - protein, 10 aa, Homo sapiens
LVPEAHPNAS

SEQ ID NO: 5579 - protein, 10 aa, Homo sapiens
TMYVCAPVPH

SEQ ID NO: 5580 - protein, 10 aa, Homo sapiens
YVCAPVPHPD

SEQ ID NO: 5581 - protein, 10 aa, Homo sapiens
SIDTDPPADG

SEQ ID NO: 5582 - protein, 10 aa, Homo sapiens
QVWSVVSPAP

SEQ ID NO: 5583 - protein, 10 aa, Homo sapiens
VVSPAPSRGQ

SEQ ID NO: 5584 - protein, 10 aa, Homo sapiens
CCSGDPASYR

SEQ ID NO: 5585 - protein, 10 aa, Homo sapiens
PQASVPLLTH

SEQ ID NO: 5586 - protein, 10 aa, Homo sapiens
AHPNASLTMY

SEQ ID NO: 5587 - protein, 10 aa, Homo sapiens
PVPHPDPPMA

SEQ ID NO: 5588 - protein, 10 aa, Homo sapiens
AFSTLNPVLR

SEQ ID NO: 5589 - protein, 10 aa, Homo sapiens
RTSRAVTPTC

SEQ ID NO: 5590 - protein, 10 aa, Homo sapiens
RAVTPTCATP

SEQ ID NO: 5591 - protein, 10 aa, Homo sapiens
PCSRLPPSLR

SEQ ID NO: 5592 - protein, 10 aa, Homo sapiens
PLCCCFHGPA

SEQ ID NO: 5593 - protein, 10 aa, Homo sapiens
RLLPSLRCSL

SEQ ID NO: 5594 - protein, 10 aa, Homo sapiens
LLPSLRCSLH

SEQ ID NO: 5595 - protein, 10 aa, Homo sapiens
PCSRLLPSLR

SEQ ID NO: 5596 - protein, 10 aa, Homo sapiens
CCSGDPASSR

SEQ ID NO: 5597 - protein, 10 aa, Homo sapiens
ASSRLWGAPL

SEQ ID NO: 5598 - protein, 10 aa, Homo sapiens
SRLWGAPLQP

SEQ ID NO: 5599 - protein, 10 aa, Homo sapiens
ACCSGDPASS

SEQ ID NO: 5600 - protein, 10 aa, Homo sapiens
SSRLWGAPLQ

SEQ ID NO: 5601 - protein, 10 aa, Homo sapiens
GDPASSRLWG

SEQ ID NO: 5602 - protein, 10 aa, Homo sapiens
PLLTDPAQWE

SEQ ID NO: 5603 - protein, 10 aa, Homo sapiens
SVPLLTDPAQ

SEQ ID NO: 5604 - protein, 10 aa, Homo sapiens
LLTDPAQWEP

SEQ ID NO: 5605 - protein, 10 aa, Homo sapiens
VPLLTDPAQW

SEQ ID NO: 5606 - protein, 10 aa, Homo sapiens
PQASVPLLTD

SEQ ID NO: 5607 - protein, 10 aa, Homo sapiens
SVPLLTDLAQ

SEQ ID NO: 5608 - protein, 10 aa, Homo sapiens
PLLTDLAQWE

SEQ ID NO: 5609 - protein, 10 aa, Homo sapiens
DLAQWEPVLV

SEQ ID NO: 5610 - protein, 10 aa, Homo sapiens
LLTDLAQWEP

SEQ ID NO: 5611 - protein, 10 aa, Homo sapiens
VPLLTDLAQW

SEQ ID NO: 5612 - protein, 10 aa, Homo sapiens
TDLAQWEPVL

SEQ ID NO: 5613 - protein, 10 aa, Homo sapiens
SVPLLTHLAQ

SEQ ID NO: 5614 - protein, 10 aa, Homo sapiens
PLLTHLAQWE

SEQ ID NO: 5615 - protein, 10 aa, Homo sapiens
HLAQWEPVLV

SEQ ID NO: 5616 - protein, 10 aa, Homo sapiens
LLTHLAQWEP

SEQ ID NO: 5617 - protein, 10 aa, Homo sapiens
VPLLTHLAQW

SEQ ID NO: 5618 - protein, 10 aa, Homo sapiens
THLAQWEPVL

SEQ ID NO: 5619 - protein, 10 aa, Homo sapiens
LAQWEPVLVP

SEQ ID NO: 5620 - protein, 10 aa, Homo sapiens
TMYVCTPVPH

SEQ ID NO: 5621 - protein, 10 aa, Homo sapiens
SLTMYVCTPV

SEQ ID NO: 5622 - protein, 10 aa, Homo sapiens
YVCTPVPHPD

SEQ ID NO: 5623 - protein, 10 aa, Homo sapiens
ASLTMYVCTP

SEQ ID NO: 5624 - protein, 10 aa, Homo sapiens
QISSIDTDPP

SEQ ID NO: 5625 - protein, 10 aa, Homo sapiens
RTPTRQISSI

SEQ ID NO: 5626 - protein, 10 aa, Homo sapiens
RQISSIDTDP

SEQ ID NO: 5627 - protein, 10 aa, Homo sapiens
SSIDTDPPAD

SEQ ID NO: 5628 - protein, 10 aa, Homo sapiens
SRTPTRQISS

SEQ ID NO: 5629 - protein, 10 aa, Homo sapiens
TPTRQISSID

SEQ ID NO: 5630 - protein, 10 aa, Homo sapiens
TRQISSIDTD

SEQ ID NO: 5631 - protein, 10 aa, Homo sapiens
LSRTPTRQIS

SEQ ID NO: 5632 - protein, 10 aa, Homo sapiens
ISSSDTDPPA

SEQ ID NO: 5633 - protein, 10 aa, Homo sapiens
SSSDTDPPAD

SEQ ID NO: 5634 - protein, 10 aa, Homo sapiens
TPTRQIGSSD

SEQ ID NO: 5635 - protein, 10 aa, Homo sapiens
RQIGSSDTDP

SEQ ID NO: 5636 - protein, 10 aa, Homo sapiens
QIGSSDTDPP

SEQ ID NO: 5637 - protein, 10 aa, Homo sapiens
RTPTRQIGSS

SEQ ID NO: 5638 - protein, 10 aa, Homo sapiens
PTRQIGSSDT

SEQ ID NO: 5639 - protein, 10 aa, Homo sapiens
TRQIGSSDTD

SEQ ID NO: 5640 - protein, 10 aa, Homo sapiens
SSDTDPPADG

SEQ ID NO: 5641 - protein, 10 aa, Homo sapiens
SDTDPPADGP

SEQ ID NO: 5642 - protein, 10 aa, Homo sapiens
PSRGQALRRA

SEQ ID NO: 5643 - protein, 10 aa, Homo sapiens
SRGQALRRAQ

SEQ ID NO: 5644 - protein, 10 aa, Homo sapiens
LTVISKGCSL

SEQ ID NO: 5645 - protein, 10 aa, Homo sapiens
TVISKGCSLN

SEQ ID NO: 5646 - protein, 10 aa, Homo sapiens
DTDLCNASGA

SEQ ID NO: 5647 - protein, 10 aa, Homo sapiens
AAILALLPAL

SEQ ID NO: 5648 - protein, 10 aa, Homo sapiens
WTARIRAVGL

SEQ ID NO: 5649 - protein, 10 aa, Homo sapiens
AVGLLTVISK

SEQ ID NO: 5650 - protein, 10 aa, Homo sapiens
AVLLALLMAG

SEQ ID NO: 5651 - protein, 10 aa, Homo sapiens
LQPGTALLCY

SEQ ID NO: 5652 - protein, 10 aa, Homo sapiens
NCVDDSQDYY

SEQ ID NO: 5653 - protein, 10 aa, Homo sapiens
DSQDYYVGKK

SEQ ID NO: 5654 - protein, 10 aa, Homo sapiens
TARIRAVGLL

SEQ ID NO: 5655 - protein, 10 aa, Homo sapiens
YVGKKNITCC

SEQ ID NO: 5656 - protein, 10 aa, Homo sapiens
LQPAAAILAL

SEQ ID NO: 5657 - protein, 10 aa, Homo sapiens
LALLPALGLL

SEQ ID NO: 5658 - protein, 10 aa, Homo sapiens
QVSNEDCLQV

SEQ ID NO: 5659 - protein, 10 aa, Homo sapiens
ENCTQLGEQC

SEQ ID NO: 5660 - protein, 10 aa, Homo sapiens
KNITCCDTDL

SEQ ID NO: 5661 - protein, 10 aa, Homo sapiens
QPAAAILALL

SEQ ID NO: 5662 - protein, 10 aa, Homo sapiens
LALLMAGLAL

SEQ ID NO: 5663 - protein, 10 aa, Homo sapiens
QVENCTQLGE

SEQ ID NO: 5664 - protein, 10 aa, Homo sapiens
EQCWTARIRA

SEQ ID NO: 5665 - protein, 10 aa, Homo sapiens
CVDDSQDYYV

SEQ ID NO: 5666 - protein, 10 aa, Homo sapiens
ALLPALGLLL

SEQ ID NO: 5667 - protein, 10 aa, Homo sapiens
KAVLLALLMA

SEQ ID NO: 5668 - protein, 10 aa, Homo sapiens
GLALQPGTAL

SEQ ID NO: 5669 - protein, 10 aa, Homo sapiens
EDCLQVENCT

SEQ ID NO: 5670 - protein, 10 aa, Homo sapiens
RIRAVGLLTV

SEQ ID NO: 5671 - protein, 10 aa, Homo sapiens
LNCVDDSQDY

SEQ ID NO: 5672 - protein, 10 aa, Homo sapiens
GLLLWGPGQL

SEQ ID NO: 5673 - protein, 10 aa, Homo sapiens
GVVPQASVPL

SEQ ID NO: 5674 - protein, 10 aa, Homo sapiens
VVPQASVPLL

SEQ ID NO: 5675 - protein, 10 aa, Homo sapiens
STLNPVLRHL

SEQ ID NO: 5676 - protein, 10 aa, Homo sapiens
DTDPPADGPS

SEQ ID NO: 5677 - protein, 10 aa, Homo sapiens
SVVSPAPSRG

SEQ ID NO: 5678 - protein, 10 aa, Homo sapiens
EAFPAHPIYD

SEQ ID NO: 5679 - protein, 10 aa, Homo sapiens
AHPNASLTMY

SEQ ID NO: 5680 - protein, 10 aa, Homo sapiens
EPVLVPEAHP

SEQ ID NO: 5681 - protein, 10 aa, Homo sapiens
RTPTRQIGSI

SEQ ID NO: 5682 - protein, 10 aa, Homo sapiens
DPASYRLWGA

SEQ ID NO: 5683 - protein, 10 aa, Homo sapiens
LVPEAHPNAS

SEQ ID NO: 5684 - protein, 10 aa, Homo sapiens
EAHPNASLTM

SEQ ID NO: 5685 - protein, 10 aa, Homo sapiens
DGPSNPLCCC

SEQ ID NO: 5686 - protein, 10 aa, Homo sapiens
PAFSTLNPVL

SEQ ID NO: 5687 - protein, 10 aa, Homo sapiens
AVTPTCATPA

SEQ ID NO: 5688 - protein, 10 aa, Homo sapiens
ACCSGDPASY

SEQ ID NO: 5689 - protein, 10 aa, Homo sapiens
SVPLLTHPAQ

SEQ ID NO: 5690 - protein, 10 aa, Homo sapiens
AFPAHPIYDL

SEQ ID NO: 5691 - protein, 10 aa, Homo sapiens
QVWSVVSPAP

SEQ ID NO: 5692 - protein, 10 aa, Homo sapiens
SPAPSRGQAL

SEQ ID NO: 5693 - protein, 10 aa, Homo sapiens
TTTWARRTSR

SEQ ID NO: 5694 - protein, 10 aa, Homo sapiens
PVPHPDPPMA

SEQ ID NO: 5695 - protein, 10 aa, Homo sapiens
PVLRHLFPQE

SEQ ID NO: 5696 - protein, 10 aa, Homo sapiens
VVSPAPSRGQ

SEQ ID NO: 5697 - protein, 10 aa, Homo sapiens
MPCSRLLPSL

SEQ ID NO: 5698 - protein, 10 aa, Homo sapiens
RLLPSLRCSL

SEQ ID NO: 5699 - protein, 10 aa, Homo sapiens
AGPMPCSRLL

SEQ ID NO: 5700 - protein, 10 aa, Homo sapiens
DPASSRLWGA

SEQ ID NO: 5701 - protein, 10 aa, Homo sapiens
CSGDPASSRL

SEQ ID NO: 5702 - protein, 10 aa, Homo sapiens
ASSRLWGAPL

SEQ ID NO: 5703 - protein, 10 aa, Homo sapiens
SVPLLTDPAQ

SEQ ID NO: 5704 - protein, 10 aa, Homo sapiens
LTDPAQWEPV

SEQ ID NO: 5705 - protein, 10 aa, Homo sapiens
TDPAQWEPVL

SEQ ID NO: 5706 - protein, 10 aa, Homo sapiens
DPAQWEPVLV

SEQ ID NO: 5707 - protein, 10 aa, Homo sapiens
PQASVPLLTD

SEQ ID NO: 5708 - protein, 10 aa, Homo sapiens
ASVPLLTDPA

SEQ ID NO: 5709 - protein, 10 aa, Homo sapiens
SVPLLTDLAQ

SEQ ID NO: 5710 - protein, 10 aa, Homo sapiens
QASVPLLTDL

SEQ ID NO: 5711 - protein, 10 aa, Homo sapiens
TDLAQWEPVL

SEQ ID NO: 5712 - protein, 10 aa, Homo sapiens
LTDLAQWEPV

SEQ ID NO: 5713 - protein, 10 aa, Homo sapiens
DLAQWEPVLV

SEQ ID NO: 5714 - protein, 10 aa, Homo sapiens
SVPLLTHLAQ

SEQ ID NO: 5715 - protein, 10 aa, Homo sapiens
QASVPLLTHL

SEQ ID NO: 5716 - protein, 10 aa, Homo sapiens
THLAQWEPVL

SEQ ID NO: 5717 - protein, 10 aa, Homo sapiens
LTHLAQWEPV

SEQ ID NO: 5718 - protein, 10 aa, Homo sapiens
YVCTPVPHPD

SEQ ID NO: 5719 - protein, 10 aa, Homo sapiens
LTMYVCTPVP

SEQ ID NO: 5720 - protein, 10 aa, Homo sapiens
MYVCTPVPHP

SEQ ID NO: 5721 - protein, 10 aa, Homo sapiens
CTPVPHPDPP

SEQ ID NO: 5722 - protein, 10 aa, Homo sapiens
TPVPHPDPPM

SEQ ID NO: 5723 - protein, 10 aa, Homo sapiens
ASLTMYVCTP

SEQ ID NO: 5724 - protein, 10 aa, Homo sapiens
RTPTRQISSI

SEQ ID NO: 5725 - protein, 10 aa, Homo sapiens
PTRQISSIDT

SEQ ID NO: 5726 - protein, 10 aa, Homo sapiens
SSIDTDPPAD

SEQ ID NO: 5727 - protein, 10 aa, Homo sapiens
TRQISSIDTD

SEQ ID NO: 5728 - protein, 10 aa, Homo sapiens
RTPTRQISSS

SEQ ID NO: 5729 - protein, 10 aa, Homo sapiens
PTRQISSSDT

SEQ ID NO: 5730 - protein, 10 aa, Homo sapiens
RTPTRQIGSS

SEQ ID NO: 5731 - protein, 10 aa, Homo sapiens
PTRQIGSSDT

SEQ ID NO: 5732 - protein, 10 aa, Homo sapiens
PSRGQALRRA

SEQ ID NO: 5733 - protein, 10 aa, Homo sapiens
SRGQALRRAQ

SEQ ID NO: 5734 - protein, 10 aa, Homo sapiens
QPAAAILALL

SEQ ID NO: 5735 - protein, 10 aa, Homo sapiens
ALLPALGLLL

SEQ ID NO: 5736 - protein, 10 aa, Homo sapiens
LQPAAAILAL

SEQ ID NO: 5737 - protein, 10 aa, Homo sapiens
AAILALLPAL

SEQ ID NO: 5738 - protein, 10 aa, Homo sapiens
ILALLPALGL

SEQ ID NO: 5739 - protein, 10 aa, Homo sapiens
LALLMAGLAL

SEQ ID NO: 5740 - protein, 10 aa, Homo sapiens
GLALQPGTAL

SEQ ID NO: 5741 - protein, 10 aa, Homo sapiens
WTARIRAVGL

SEQ ID NO: 5742 - protein, 10 aa, Homo sapiens
TARIRAVGLL

SEQ ID NO: 5743 - protein, 10 aa, Homo sapiens
LPALGLLLWG

SEQ ID NO: 5744 - protein, 10 aa, Homo sapiens
VLLALLMAGL

SEQ ID NO: 5745 - protein, 10 aa, Homo sapiens
LALQPGTALL

SEQ ID NO: 5746 - protein, 10 aa, Homo sapiens
RIRAVGLLTV

SEQ ID NO: 5747 - protein, 10 aa, Homo sapiens
KNITCCDTDL

SEQ ID NO: 5748 - protein, 10 aa, Homo sapiens
LCNASGAHAL

SEQ ID NO: 5749 - protein, 10 aa, Homo sapiens
AAAILALLPA

SEQ ID NO: 5750 - protein, 10 aa, Homo sapiens
QPGTALLCYS

SEQ ID NO: 5751 - protein, 10 aa, Homo sapiens
KAQVSNEDCL

SEQ ID NO: 5752 - protein, 10 aa, Homo sapiens
CLQVENCTQL

SEQ ID NO: 5753 - protein, 10 aa, Homo sapiens
ASGAHALQPA

SEQ ID NO: 5754 - protein, 10 aa, Homo sapiens
AHALQPAAAI

SEQ ID NO: 5755 - protein, 10 aa, Homo sapiens
HALQPAAAIL

SEQ ID NO: 5756 - protein, 10 aa, Homo sapiens
SPAPSRGQAL

SEQ ID NO: 5757 - protein, 10 aa, Homo sapiens
VPEAHPNASL

SEQ ID NO: 5758 - protein, 10 aa, Homo sapiens
VPHPDPPMAL

SEQ ID NO: 5759 - protein, 10 aa, Homo sapiens
PPADGPSNPL

SEQ ID NO: 5760 - protein, 10 aa, Homo sapiens
MPCSRLPPSL

SEQ ID NO: 5761 - protein, 10 aa, Homo sapiens
APVPHPDPPM

SEQ ID NO: 5762 - protein, 10 aa, Homo sapiens
PPMALSRTPT

SEQ ID NO: 5763 - protein, 10 aa, Homo sapiens
APLQPTLGVV

SEQ ID NO: 5764 - protein, 10 aa, Homo sapiens
VPQASVPLLT

SEQ ID NO: 5765 - protein, 10 aa, Homo sapiens
HPAQWEPVLV

SEQ ID NO: 5766 - protein, 10 aa, Homo sapiens
QPTLGVVPQA

SEQ ID NO: 5767 - protein, 10 aa, Homo sapiens
HPNASLTMYV

SEQ ID NO: 5768 - protein, 10 aa, Homo sapiens
GPSNPLCCCF

SEQ ID NO: 5769 - protein, 10 aa, Homo sapiens
GPAFSTLNPV

SEQ ID NO: 5770 - protein, 10 aa, Homo sapiens
DPASYRLWGA

SEQ ID NO: 5771 - protein, 10 aa, Homo sapiens
GPMPCSRLPP

SEQ ID NO: 5772 - protein, 10 aa, Homo sapiens
APSRGQALRR

SEQ ID NO: 5773 - protein, 10 aa, Homo sapiens
PPSLRCSLHS

SEQ ID NO: 5774 - protein, 10 aa, Homo sapiens
ASYRLWGAPL

SEQ ID NO: 5775 - protein, 10 aa, Homo sapiens
GVVPQASVPL

SEQ ID NO: 5776 - protein, 10 aa, Homo sapiens
HPDPPMALSR

SEQ ID NO: 5777 - protein, 10 aa, Homo sapiens
TPAGPMPCSR

SEQ ID NO: 5778 - protein, 10 aa, Homo sapiens
RLPPSLRCSL

SEQ ID NO: 5779 - protein, 10 aa, Homo sapiens
LWGAPLQPTL

SEQ ID NO: 5780 - protein, 10 aa, Homo sapiens
THPAQWEPVL

SEQ ID NO: 5781 - protein, 10 aa, Homo sapiens
CFHGPAFSTL

SEQ ID NO: 5782 - protein, 10 aa, Homo sapiens
AFPAHPIYDL

SEQ ID NO: 5783 - protein, 10 aa, Homo sapiens
PAGPMPCSRL

SEQ ID NO: 5784 - protein, 10 aa, Homo sapiens
VVPQASVPLL

SEQ ID NO: 5785 - protein, 10 aa, Homo sapiens
EPVLVPEAHP

SEQ ID NO: 5786 - protein, 10 aa, Homo sapiens
PAFSTLNPVL

SEQ ID NO: 5787 - protein, 10 aa, Homo sapiens
WARRTSRAVT

SEQ ID NO: 5788 - protein, 10 aa, Homo sapiens
AVTPTCATPA

SEQ ID NO: 5789 - protein, 10 aa, Homo sapiens
TPTCATPAGP

SEQ ID NO: 5790 - protein, 10 aa, Homo sapiens
CSGDPASYRL

SEQ ID NO: 5791 - protein, 10 aa, Homo sapiens
ASVPLLTHPA

SEQ ID NO: 5792 - protein, 10 aa, Homo sapiens
VPLLTHPAQW

SEQ ID NO: 5793 - protein, 10 aa, Homo sapiens
ALSRTPTRQI

SEQ ID NO: 5794 - protein, 10 aa, Homo sapiens
IGSIDTDPPA

SEQ ID NO: 5795 - protein, 10 aa, Homo sapiens
DPPADGPSNP

SEQ ID NO: 5796 - protein, 10 aa, Homo sapiens
NPLCCCFHGP

SEQ ID NO: 5797 - protein, 10 aa, Homo sapiens
NPVLRHLFPQ

SEQ ID NO: 5798 - protein, 10 aa, Homo sapiens
FPQEAFPAHP

SEQ ID NO: 5799 - protein, 10 aa, Homo sapiens
FPAHPIYDLS

SEQ ID NO: 5800 - protein, 10 aa, Homo sapiens
HPIYDLSQVW

SEQ ID NO: 5801 - protein, 10 aa, Homo sapiens
MPCSRLLPSL

SEQ ID NO: 5802 - protein, 10 aa, Homo sapiens
GPMPCSRLLP

SEQ ID NO: 5803 - protein, 10 aa, Homo sapiens
LPSLRCSLHS

SEQ ID NO: 5804 - protein, 10 aa, Homo sapiens
RLLPSLRCSL

SEQ ID NO: 5805 - protein, 10 aa, Homo sapiens
AGPMPCSRLL

SEQ ID NO: 5806 - protein, 10 aa, Homo sapiens
DPASSRLWGA

SEQ ID NO: 5807 - protein, 10 aa, Homo sapiens
ASSRLWGAPL

SEQ ID NO: 5808 - protein, 10 aa, Homo sapiens
CSGDPASSRL

SEQ ID NO: 5809 - protein, 10 aa, Homo sapiens
DPAQWEPVLV

SEQ ID NO: 5810 - protein, 10 aa, Homo sapiens
TDPAQWEPVL

SEQ ID NO: 5811 - protein, 10 aa, Homo sapiens
ASVPLLTDPA

SEQ ID NO: 5812 - protein, 10 aa, Homo sapiens
VPLLTDPAQW

SEQ ID NO: 5813 - protein, 10 aa, Homo sapiens
LTDPAQWEPV

SEQ ID NO: 5814 - protein, 10 aa, Homo sapiens
QASVPLLTDL

SEQ ID NO: 5815 - protein, 10 aa, Homo sapiens
TDLAQWEPVL

SEQ ID NO: 5816 - protein, 10 aa, Homo sapiens
VPLLTDLAQW

SEQ ID NO: 5817 - protein, 10 aa, Homo sapiens
ASVPLLTDLA

SEQ ID NO: 5818 - protein, 10 aa, Homo sapiens
DLAQWEPVLV

SEQ ID NO: 5819 - protein, 10 aa, Homo sapiens
LTDLAQWEPV

SEQ ID NO: 5820 - protein, 10 aa, Homo sapiens
QASVPLLTHL

SEQ ID NO: 5821 - protein, 10 aa, Homo sapiens
THLAQWEPVL

SEQ ID NO: 5822 - protein, 10 aa, Homo sapiens
VPLLTHLAQW

SEQ ID NO: 5823 - protein, 10 aa, Homo sapiens
ASVPLLTHLA

SEQ ID NO: 5824 - protein, 10 aa, Homo sapiens
HLAQWEPVLV

SEQ ID NO: 5825 - protein, 10 aa, Homo sapiens
TPVPHPDPPM

SEQ ID NO: 5826 - protein, 10 aa, Homo sapiens
NASLTMYVCT

SEQ ID NO: 5827 - protein, 10 aa, Homo sapiens
ISSIDTDPPA

SEQ ID NO: 5828 - protein, 10 aa, Homo sapiens
TPTRQISSID

SEQ ID NO: 5829 - protein, 10 aa, Homo sapiens
PTRQISSIDT

SEQ ID NO: 5830 - protein, 10 aa, Homo sapiens
RTPTRQISSI

SEQ ID NO: 5831 - protein, 10 aa, Homo sapiens
ISSSDTDPPA

SEQ ID NO: 5832 - protein, 10 aa, Homo sapiens
TPTRQISSSD

SEQ ID NO: 5833 - protein, 10 aa, Homo sapiens
PTRQISSSDT

SEQ ID NO: 5834 - protein, 10 aa, Homo sapiens
IGSSDTDPPA

SEQ ID NO: 5835 - protein, 10 aa, Homo sapiens
TPTRQIGSSD

SEQ ID NO: 5836 - protein, 10 aa, Homo sapiens
PTRQIGSSDT

SEQ ID NO: 5837 - protein, 10 aa, Homo sapiens
PSRGQALRRA

SEQ ID NO: 5838 - protein, 10 aa, Homo sapiens
AAILALLPAL

SEQ ID NO: 5839 - protein, 10 aa, Homo sapiens
ALLPALGLLL

SEQ ID NO: 5840 - protein, 10 aa, Homo sapiens
LQPAAAILAL

SEQ ID NO: 5841 - protein, 10 aa, Homo sapiens
LALLMAGLAL

SEQ ID NO: 5842 - protein, 10 aa, Homo sapiens
KNITCCDTDL

SEQ ID NO: 5843 - protein, 10 aa, Homo sapiens
AHALQPAAAI

SEQ ID NO: 5844 - protein, 10 aa, Homo sapiens
LQPGTALLCY

SEQ ID NO: 5845 - protein, 10 aa, Homo sapiens
LCNASGAHAL

SEQ ID NO: 5846 - protein, 10 aa, Homo sapiens
LALLPALGLL

SEQ ID NO: 5847 - protein, 10 aa, Homo sapiens
LLPALGLLLW

SEQ ID NO: 5848 - protein, 10 aa, Homo sapiens
GLLLWGPGQL

SEQ ID NO: 5849 - protein, 10 aa, Homo sapiens
GLALQPGTAL

SEQ ID NO: 5850 - protein, 10 aa, Homo sapiens
LALQPGTALL

SEQ ID NO: 5851 - protein, 10 aa, Homo sapiens
NEDCLQVENC

SEQ ID NO: 5852 - protein, 10 aa, Homo sapiens
WTARIRAVGL

SEQ ID NO: 5853 - protein, 10 aa, Homo sapiens
ILALLPALGL

SEQ ID NO: 5854 - protein, 10 aa, Homo sapiens
GEQCWTARIR

SEQ ID NO: 5855 - protein, 10 aa, Homo sapiens
TARIRAVGLL

SEQ ID NO: 5856 - protein, 10 aa, Homo sapiens
NCVDDSQDYY

SEQ ID NO: 5857 - protein, 10 aa, Homo sapiens
HALQPAAAIL

SEQ ID NO: 5858 - protein, 10 aa, Homo sapiens
QPAAAILALL

SEQ ID NO: 5859 - protein, 10 aa, Homo sapiens
VLLALLMAGL

SEQ ID NO: 5860 - protein, 10 aa, Homo sapiens
KAQVSNEDCL

SEQ ID NO: 5861 - protein, 10 aa, Homo sapiens
CLQVENCTQL

SEQ ID NO: 5862 - protein, 10 aa, Homo sapiens
VENCTQLGEQ

SEQ ID NO: 5863 - protein, 10 aa, Homo sapiens
NCTQLGEQCW

SEQ ID NO: 5864 - protein, 10 aa, Homo sapiens
IRAVGLLTVI

SEQ ID NO: 5865 - protein, 10 aa, Homo sapiens
LTVISKGCSL

SEQ ID NO: 5866 - protein, 10 aa, Homo sapiens
LNCVDDSQDY

SEQ ID NO: 5867 - protein, 10 aa, Homo sapiens
QDYYVGKKNI

SEQ ID NO: 5868 - protein, 10 aa, Homo sapiens
ALQPGTALLC

SEQ ID NO: 5869 - protein, 10 aa, Homo sapiens
LGEQCWTARI

SEQ ID NO: 5870 - protein, 10 aa, Homo sapiens
ARIRAVGLLT

SEQ ID NO: 5871 - protein, 10 aa, Homo sapiens
ALQPAAAILA

SEQ ID NO: 5872 - protein, 10 aa, Homo sapiens
QEAFPAHPIY

SEQ ID NO: 5873 - protein, 10 aa, Homo sapiens
SGDPASYRLW

SEQ ID NO: 5874 - protein, 10 aa, Homo sapiens
AFPAHPIYDL

SEQ ID NO: 5875 - protein, 10 aa, Homo sapiens
AHPNASLTMY

SEQ ID NO: 5876 - protein, 10 aa, Homo sapiens
VPHPDPPMAL

SEQ ID NO: 5877 - protein, 10 aa, Homo sapiens
ALSRTPTRQI

SEQ ID NO: 5878 - protein, 10 aa, Homo sapiens
TLNPVLRHLF

SEQ ID NO: 5879 - protein, 10 aa, Homo sapiens
SPAPSRGQAL

SEQ ID NO: 5880 - protein, 10 aa, Homo sapiens
RLPPSLRCSL

SEQ ID NO: 5881 - protein, 10 aa, Homo sapiens
STLNPVLRHL

SEQ ID NO: 5882 - protein, 10 aa, Homo sapiens
ACCSGDPASY

SEQ ID NO: 5883 - protein, 10 aa, Homo sapiens
ASYRLWGAPL

SEQ ID NO: 5884 - protein, 10 aa, Homo sapiens
GVVPQASVPL

SEQ ID NO: 5885 - protein, 10 aa, Homo sapiens
VPLLTHPAQW

SEQ ID NO: 5886 - protein, 10 aa, Homo sapiens
WEPVLVPEAH

SEQ ID NO: 5887 - protein, 10 aa, Homo sapiens
HPIYDLSQVW

SEQ ID NO: 5888 - protein, 10 aa, Homo sapiens
PAGPMPCSRL

SEQ ID NO: 5889 - protein, 10 aa, Homo sapiens
VVPQASVPLL

SEQ ID NO: 5890 - protein, 10 aa, Homo sapiens
RTPTRQIGSI

SEQ ID NO: 5891 - protein, 10 aa, Homo sapiens
CFHGPAFSTL

SEQ ID NO: 5892 - protein, 10 aa, Homo sapiens
PAFSTLNPVL

SEQ ID NO: 5893 - protein, 10 aa, Homo sapiens
LRHLFPQEAF

SEQ ID NO: 5894 - protein, 10 aa, Homo sapiens
THPAQWEPVL

SEQ ID NO: 5895 - protein, 10 aa, Homo sapiens
PEAHPNASLT

SEQ ID NO: 5896 - protein, 10 aa, Homo sapiens
PPADGPSNPL

SEQ ID NO: 5897 - protein, 10 aa, Homo sapiens
GPSNPLCCCF

SEQ ID NO: 5898 - protein, 10 aa, Homo sapiens
LCCCFHGPAF

SEQ ID NO: 5899 - protein, 10 aa, Homo sapiens
MPCSRLPPSL

SEQ ID NO: 5900 - protein, 10 aa, Homo sapiens
CSGDPASYRL

SEQ ID NO: 5901 - protein, 10 aa, Homo sapiens
LWGAPLQPTL

SEQ ID NO: 5902 - protein, 10 aa, Homo sapiens
VPEAHPNASL

SEQ ID NO: 5903 - protein, 10 aa, Homo sapiens
PQEAFPAHPI

SEQ ID NO: 5904 - protein, 10 aa, Homo sapiens
EAFPAHPIYD

SEQ ID NO: 5905 - protein, 10 aa, Homo sapiens
AGPMPCSRLL

SEQ ID NO: 5906 - protein, 10 aa, Homo sapiens
RLLPSLRCSL

SEQ ID NO: 5907 - protein, 10 aa, Homo sapiens
MPCSRLLPSL

SEQ ID NO: 5908 - protein, 10 aa, Homo sapiens
GPMPCSRLLP

SEQ ID NO: 5909 - protein, 10 aa, Homo sapiens
SGDPASSRLW

SEQ ID NO: 5910 - protein, 10 aa, Homo sapiens
ASSRLWGAPL

SEQ ID NO: 5911 - protein, 10 aa, Homo sapiens
CSGDPASSRL

SEQ ID NO: 5912 - protein, 10 aa, Homo sapiens
VPLLTDPAQW

SEQ ID NO: 5913 - protein, 10 aa, Homo sapiens
TDPAQWEPVL

SEQ ID NO: 5914 - protein, 10 aa, Homo sapiens
ASVPLLTDPA

SEQ ID NO: 5915 - protein, 10 aa, Homo sapiens
VPLLTDLAQW

SEQ ID NO: 5916 - protein, 10 aa, Homo sapiens
QASVPLLTDL

SEQ ID NO: 5917 - protein, 10 aa, Homo sapiens
TDLAQWEPVL

SEQ ID NO: 5918 - protein, 10 aa, Homo sapiens
ASVPLLTDLA

SEQ ID NO: 5919 - protein, 10 aa, Homo sapiens
SVPLLTDLAQ

SEQ ID NO: 5920 - protein, 10 aa, Homo sapiens
VPLLTHLAQW

SEQ ID NO: 5921 - protein, 10 aa, Homo sapiens
QASVPLLTHL

SEQ ID NO: 5922 - protein, 10 aa, Homo sapiens
THLAQWEPVL

SEQ ID NO: 5923 - protein, 10 aa, Homo sapiens
ASVPLLTHLA

SEQ ID NO: 5924 - protein, 10 aa, Homo sapiens
SVPLLTHLAQ

SEQ ID NO: 5925 - protein, 10 aa, Homo sapiens
ASLTMYVCTP

SEQ ID NO: 5926 - protein, 10 aa, Homo sapiens
NASLTMYVCT

SEQ ID NO: 5927 - protein, 10 aa, Homo sapiens
LTMYVCTPVP

SEQ ID NO: 5928 - protein, 10 aa, Homo sapiens
YVCTPVPHPD

SEQ ID NO: 5929 - protein, 10 aa, Homo sapiens
VCTPVPHPDP

SEQ ID NO: 5930 - protein, 10 aa, Homo sapiens
TPVPHPDPPM

SEQ ID NO: 5931 - protein, 10 aa, Homo sapiens
RTPTRQISSI

SEQ ID NO: 5932 - protein, 10 aa, Homo sapiens
SSIDTDPPAD

SEQ ID NO: 5933 - protein, 10 aa, Homo sapiens
SSSDTDPPAD

SEQ ID NO: 5934 - protein, 10 aa, Homo sapiens
RTPTRQISSS

SEQ ID NO: 5935 - protein, 10 aa, Homo sapiens
RQISSSDTDP

SEQ ID NO: 5936 - protein, 10 aa, Homo sapiens
QISSSDTDPP

SEQ ID NO: 5937 - protein, 10 aa, Homo sapiens
RTPTRQIGSS

SEQ ID NO: 5938 - protein, 10 aa, Homo sapiens
GSSDTDPPAD

SEQ ID NO: 5939 - protein, 10 aa, Homo sapiens
RQIGSSDTDP

SEQ ID NO: 5940 - protein, 10 aa, Homo sapiens
SSDTDPPADG

SEQ ID NO: 5941 - protein, 10 aa, Homo sapiens
SDTDPPADGP

SEQ ID NO: 5942 - protein, 10 aa, Homo sapiens
SRGQALRRAQ

SEQ ID NO: 5943 - protein, 10 aa, Homo sapiens
PSRGQALRRA

SEQ ID NO: 5944 - protein, 15 aa, Homo sapiens
AAILALLPALGLLLW

SEQ ID NO: 5945 - protein, 15 aa, Homo sapiens
AVLLALLMAGLALQP

SEQ ID NO: 5946 - protein, 15 aa, Homo sapiens
MAGLALQPGTALLCY

SEQ ID NO: 5947 - protein, 15 aa, Homo sapiens
KAVLLALLMAGLALQ

SEQ ID NO: 5948 - protein, 15 aa, Homo sapiens
TARIRAVGLLTVISK

SEQ ID NO: 5949 - protein, 15 aa, Homo sapiens
LALLMAGLALQPGTA

SEQ ID NO: 5950 - protein, 15 aa, Homo sapiens
QCWTARIRAVGLLTV

SEQ ID NO: 5951 - protein, 15 aa, Homo sapiens
DTDLCNASGAHALQP

SEQ ID NO: 5952 - protein, 15 aa, Homo sapiens
AHALQPAAAILALLP

SEQ ID NO: 5953 - protein, 15 aa, Homo sapiens
ILALLPALGLLLWGP

SEQ ID NO: 5954 - protein, 15 aa, Homo sapiens
VLLALLMAGLALQPG

SEQ ID NO: 5955 - protein, 15 aa, Homo sapiens
RIRAVGLLTVISKGC

SEQ ID NO: 5956 - protein, 15 aa, Homo sapiens
AVGLLTVISKGCSLN

SEQ ID NO: 5957 - protein, 15 aa, Homo sapiens
VGLLTVISKGCSLNC

SEQ ID NO: 5958 - protein, 15 aa, Homo sapiens
SGAHALQPAAAILAL

SEQ ID NO: 5959 - protein, 15 aa, Homo sapiens
LMAGLALQPGTALLC

SEQ ID NO: 5960 - protein, 15 aa, Homo sapiens
ASGAHALQPAAAILA

SEQ ID NO: 5961 - protein, 15 aa, Homo sapiens
LQPAAAILALLPALG

SEQ ID NO: 5962 - protein, 15 aa, Homo sapiens
AAAILALLPALGLLL

SEQ ID NO: 5963 - protein, 15 aa, Homo sapiens
GLLTVISKGCSLNCV

SEQ ID NO: 5964 - protein, 15 aa, Homo sapiens
CCDTDLCNASGAHAL

SEQ ID NO: 5965 - protein, 15 aa, Homo sapiens
QPAAAILALLPALGL

SEQ ID NO: 5966 - protein, 15 aa, Homo sapiens
TDLCNASGAHALQPA

SEQ ID NO: 5967 - protein, 15 aa, Homo sapiens
LLPALGLLLWGPGQL

SEQ ID NO: 5968 - protein, 15 aa, Homo sapiens
EDCLQVENCTQLGEQ

SEQ ID NO: 5969 - protein, 15 aa, Homo sapiens
IRAVGLLTVISKGCS

SEQ ID NO: 5970 - protein, 15 aa, Homo sapiens
LALLPALGLLLWGPG

SEQ ID NO: 5971 - protein, 15 aa, Homo sapiens
NPVLRHLFPQEAFPA

SEQ ID NO: 5972 - protein, 15 aa, Homo sapiens
LRHLFPQEAFPAHPI

SEQ ID NO: 5973 - protein, 15 aa, Homo sapiens
SQVWSVVSPAPSRGQ

SEQ ID NO: 5974 - protein, 15 aa, Homo sapiens
TLGVVPQASVPLLTH

SEQ ID NO: 5975 - protein, 15 aa, Homo sapiens
TRQIGSIDTDPPADG

SEQ ID NO: 5976 - protein, 15 aa, Homo sapiens
IYDLSQVWSVVSPAP

SEQ ID NO: 5977 - protein, 15 aa, Homo sapiens
LSQVWSVVSPAPSRG

SEQ ID NO: 5978 - protein, 15 aa, Homo sapiens
SRAVTPTCATPAGPM

SEQ ID NO: 5979 - protein, 15 aa, Homo sapiens
TTTWARRTSRAVTPT

SEQ ID NO: 5980 - protein, 15 aa, Homo sapiens
DPASYRLWGAPLQPT

SEQ ID NO: 5981 - protein, 15 aa, Homo sapiens
GAPLQPTLGVVPQAS

SEQ ID NO: 5982 - protein, 15 aa, Homo sapiens
PAQWEPVLVPEAHPN

SEQ ID NO: 5983 - protein, 15 aa, Homo sapiens
GPAFSTLNPVLRHLF

SEQ ID NO: 5984 - protein, 15 aa, Homo sapiens
AHPIYDLSQVWSVVS

SEQ ID NO: 5985 - protein, 15 aa, Homo sapiens
RRTSRAVTPTCATPA

SEQ ID NO: 5986 - protein, 15 aa, Homo sapiens
LWGAPLQPTLGVVPQ

SEQ ID NO: 5987 - protein, 15 aa, Homo sapiens
PQASVPLLTHPAQWE

SEQ ID NO: 5988 - protein, 15 aa, Homo sapiens
PMALSRTPTRQIGSI

SEQ ID NO: 5989 - protein, 15 aa, Homo sapiens
FSTLNPVLRHLFPQE

SEQ ID NO: 5990 - protein, 15 aa, Homo sapiens
PASYRLWGAPLQPTL

SEQ ID NO: 5991 - protein, 15 aa, Homo sapiens
QPTLGVVPQASVPLL

SEQ ID NO: 5992 - protein, 15 aa, Homo sapiens
PVLVPEAHPNASLTM

SEQ ID NO: 5993 - protein, 15 aa, Homo sapiens
ASLTMYVCAPVPHPD

SEQ ID NO: 5994 - protein, 15 aa, Homo sapiens
CAPVPHPDPPMALSR

SEQ ID NO: 5995 - protein, 15 aa, Homo sapiens
LQPTLGVVPQASVPL

SEQ ID NO: 5996 - protein, 15 aa, Homo sapiens
LTMYVCAPVPHPDPP

SEQ ID NO: 5997 - protein, 15 aa, Homo sapiens
GSIDTDPPADGPSNP

SEQ ID NO: 5998 - protein, 15 aa, Homo sapiens
HPIYDLSQVWSVVSP

SEQ ID NO: 5999 - protein, 15 aa, Homo sapiens
TWARRTSRAVTPTCA

SEQ ID NO: 6000 - protein, 15 aa, Homo sapiens
YRLWGAPLQPTLGVV

SEQ ID NO: 6001 - protein, 15 aa, Homo sapiens
NASLTMYVCAPVPHP

SEQ ID NO: 6002 - protein, 15 aa, Homo sapiens
CCCFHGPAFSTLNPV

SEQ ID NO: 6003 - protein, 15 aa, Homo sapiens
QEAFPAHPIYDLSQV

SEQ ID NO: 6004 - protein, 15 aa, Homo sapiens
AVTPTCATPAGPMPC

SEQ ID NO: 6005 - protein, 15 aa, Homo sapiens
SLRCSLHSACCSGDP

SEQ ID NO: 6006 - protein, 15 aa, Homo sapiens
PTLGVVPQASVPLLT

SEQ ID NO: 6007 - protein, 15 aa, Homo sapiens
QASVPLLTHPAQWEP

SEQ ID NO: 6008 - protein, 15 aa, Homo sapiens
VPLLTHPAQWEPVLV

SEQ ID NO: 6009 - protein, 15 aa, Homo sapiens
WEPVLVPEAHPNASL

SEQ ID NO: 6010 - protein, 15 aa, Homo sapiens
EPVLVPEAHPNASLT

SEQ ID NO: 6011 - protein, 15 aa, Homo sapiens
WSVVSPAPSRGQALR

SEQ ID NO: 6012 - protein, 15 aa, Homo sapiens
VTPTCATPAGPMPCS

SEQ ID NO: 6013 - protein, 15 aa, Homo sapiens
TPTCATPAGPMPCSR

SEQ ID NO: 6014 - protein, 15 aa, Homo sapiens
TPAGPMPCSRLPPSL

SEQ ID NO: 6015 - protein, 15 aa, Homo sapiens
AGPMPCSRLPPSLRC

SEQ ID NO: 6016 - protein, 15 aa, Homo sapiens
CSRLPPSLRCSLHSA

SEQ ID NO: 6017 - protein, 15 aa, Homo sapiens
SLHSACCSGDPASYR

SEQ ID NO: 6018 - protein, 15 aa, Homo sapiens
LGVVPQASVPLLTHP

SEQ ID NO: 6019 - protein, 15 aa, Homo sapiens
SVPLLTHPAQWEPVL

SEQ ID NO: 6020 - protein, 15 aa, Homo sapiens
QWEPVLVPEAHPNAS

SEQ ID NO: 6021 - protein, 15 aa, Homo sapiens
HPDPPMALSRTPTRQ

SEQ ID NO: 6022 - protein, 15 aa, Homo sapiens
SNPLCCCFHGPAFST

SEQ ID NO: 6023 - protein, 15 aa, Homo sapiens
NPLCCCFHGPAFSTL

SEQ ID NO: 6024 - protein, 15 aa, Homo sapiens
PLCCCFHGPAFSTLN

SEQ ID NO: 6025 - protein, 15 aa, Homo sapiens
STLNPVLRHLFPQEA

SEQ ID NO: 6026 - protein, 15 aa, Homo sapiens
LFPQEAFPAHPIYDL

SEQ ID NO: 6027 - protein, 15 aa, Homo sapiens
VVSPAPSRGQALRRA

SEQ ID NO: 6028 - protein, 15 aa, Homo sapiens
RLPPSLRCSLHSACC

SEQ ID NO: 6029 - protein, 15 aa, Homo sapiens
RLWGAPLQPTLGVVP

SEQ ID NO: 6030 - protein, 15 aa, Homo sapiens
LTHPAQWEPVLVPEA

SEQ ID NO: 6031 - protein, 15 aa, Homo sapiens
EAHPNASLTMYVCAP

SEQ ID NO: 6032 - protein, 15 aa, Homo sapiens
DPPMALSRTPTRQIG

SEQ ID NO: 6033 - protein, 15 aa, Homo sapiens
SRTPTRQIGSIDTDP

SEQ ID NO: 6034 - protein, 15 aa, Homo sapiens
RTPTRQIGSIDTDPP

SEQ ID NO: 6035 - protein, 15 aa, Homo sapiens
DTDPPADGPSNPLCC

SEQ ID NO: 6036 - protein, 15 aa, Homo sapiens
VWSVVSPAPSRGQAL

SEQ ID NO: 6037 - protein, 15 aa, Homo sapiens
MPCSRLLPSLRCSLH

SEQ ID NO: 6038 - protein, 15 aa, Homo sapiens
TPAGPMPCSRLLPSL

SEQ ID NO: 6039 - protein, 15 aa, Homo sapiens
AGPMPCSRLLPSLRC

SEQ ID NO: 6040 - protein, 15 aa, Homo sapiens
CSRLLPSLRCSLHSA

SEQ ID NO: 6041 - protein, 15 aa, Homo sapiens
SRLLPSLRCSLHSAC

SEQ ID NO: 6042 - protein, 15 aa, Homo sapiens
RLLPSLRCSLHSACC

SEQ ID NO: 6043 - protein, 15 aa, Homo sapiens
ATPAGPMPCSRLLPS

SEQ ID NO: 6044 - protein, 15 aa, Homo sapiens
PMPCSRLLPSLRCSL

SEQ ID NO: 6045 - protein, 15 aa, Homo sapiens
PCSRLLPSLRCSLHS

SEQ ID NO: 6046 - protein, 15 aa, Homo sapiens
LPSLRCSLHSACCSG

SEQ ID NO: 6047 - protein, 15 aa, Homo sapiens
TCATPAGPMPCSRLL

SEQ ID NO: 6048 - protein, 15 aa, Homo sapiens
PAGPMPCSRLLPSLR

SEQ ID NO: 6049 - protein, 15 aa, Homo sapiens
GPMPCSRLLPSLRCS

SEQ ID NO: 6050 - protein, 15 aa, Homo sapiens
LLPSLRCSLHSACCS

SEQ ID NO: 6051 - protein, 15 aa, Homo sapiens
DPASSRLWGAPLQPT

SEQ ID NO: 6052 - protein, 15 aa, Homo sapiens
SRLWGAPLQPTLGVV

SEQ ID NO: 6053 - protein, 15 aa, Homo sapiens
SLHSACCSGDPASSR

SEQ ID NO: 6054 - protein, 15 aa, Homo sapiens
CSLHSACCSGDPASS

SEQ ID NO: 6055 - protein, 15 aa, Homo sapiens
HSACCSGDPASSRLW

SEQ ID NO: 6056 - protein, 15 aa, Homo sapiens
ACCSGDPASSRLWGA

SEQ ID NO: 6057 - protein, 15 aa, Homo sapiens
ASSRLWGAPLQPTLG

SEQ ID NO: 6058 - protein, 15 aa, Homo sapiens
PASSRLWGAPLQPTL

SEQ ID NO: 6059 - protein, 15 aa, Homo sapiens
TLGVVPQASVPLLTD

SEQ ID NO: 6060 - protein, 15 aa, Homo sapiens
PQASVPLLTDPAQWE

SEQ ID NO: 6061 - protein, 15 aa, Homo sapiens
QASVPLLTDPAQWEP

SEQ ID NO: 6062 - protein, 15 aa, Homo sapiens
VPLLTDPAQWEPVLV

SEQ ID NO: 6063 - protein, 15 aa, Homo sapiens
LGVVPQASVPLLTDP

SEQ ID NO: 6064 - protein, 15 aa, Homo sapiens
SVPLLTDPAQWEPVL

SEQ ID NO: 6065 - protein, 15 aa, Homo sapiens
LTDPAQWEPVLVPEA

SEQ ID NO: 6066 - protein, 15 aa, Homo sapiens
LLTDPAQWEPVLVPE

SEQ ID NO: 6067 - protein, 15 aa, Homo sapiens
VPLLTDLAQWEPVLV

SEQ ID NO: 6068 - protein, 15 aa, Homo sapiens
PQASVPLLTDLAQWE

SEQ ID NO: 6069 - protein, 15 aa, Homo sapiens
LTDLAQWEPVLVPEA

SEQ ID NO: 6070 - protein, 15 aa, Homo sapiens
QASVPLLTDLAQWEP

SEQ ID NO: 6071 - protein, 15 aa, Homo sapiens
LGVVPQASVPLLTDL

SEQ ID NO: 6072 - protein, 15 aa, Homo sapiens
SVPLLTDLAQWEPVL

SEQ ID NO: 6073 - protein, 15 aa, Homo sapiens
LLTDLAQWEPVLVPE

SEQ ID NO: 6074 - protein, 15 aa, Homo sapiens
VPLLTHLAQWEPVLV

SEQ ID NO: 6075 - protein, 15 aa, Homo sapiens
LAQWEPVLVPEAHPN

SEQ ID NO: 6076 - protein, 15 aa, Homo sapiens
PQASVPLLTHLAQWE

SEQ ID NO: 6077 - protein, 15 aa, Homo sapiens
LTHLAQWEPVLVPEA

SEQ ID NO: 6078 - protein, 15 aa, Homo sapiens
QASVPLLTHLAQWEP

SEQ ID NO: 6079 - protein, 15 aa, Homo sapiens
LGVVPQASVPLLTHL

SEQ ID NO: 6080 - protein, 15 aa, Homo sapiens
SVPLLTHLAQWEPVL

SEQ ID NO: 6081 - protein, 15 aa, Homo sapiens
LLTHLAQWEPVLVPE

SEQ ID NO: 6082 - protein, 15 aa, Homo sapiens
CTPVPHPDPPMALSR

SEQ ID NO: 6083 - protein, 15 aa, Homo sapiens
ASLTMYVCTPVPHPD

SEQ ID NO: 6084 - protein, 15 aa, Homo sapiens
NASLTMYVCTPVPHP

SEQ ID NO: 6085 - protein, 15 aa, Homo sapiens
LTMYVCTPVPHPDPP

SEQ ID NO: 6086 - protein, 15 aa, Homo sapiens
EAHPNASLTMYVCTP

SEQ ID NO: 6087 - protein, 15 aa, Homo sapiens
MYVCTPVPHPDPPMA

SEQ ID NO: 6088 - protein, 15 aa, Homo sapiens
PNASLTMYVCTPVPH

SEQ ID NO: 6089 - protein, 15 aa, Homo sapiens
SLTMYVCTPVPHPDP

SEQ ID NO: 6090 - protein, 15 aa, Homo sapiens
TMYVCTPVPHPDPPM

SEQ ID NO: 6091 - protein, 15 aa, Homo sapiens
YVCTPVPHPDPPMAL

SEQ ID NO: 6092 - protein, 15 aa, Homo sapiens
TPVPHPDPPMALSRT

SEQ ID NO: 6093 - protein, 15 aa, Homo sapiens
TRQISSIDTDPPADG

SEQ ID NO: 6094 - protein, 15 aa, Homo sapiens
PMALSRTPTRQISSI

SEQ ID NO: 6095 - protein, 15 aa, Homo sapiens
SSIDTDPPADGPSNP

SEQ ID NO: 6096 - protein, 15 aa, Homo sapiens
DPPMALSRTPTRQIS

SEQ ID NO: 6097 - protein, 15 aa, Homo sapiens
RTPTRQISSIDTDPP

SEQ ID NO: 6098 - protein, 15 aa, Homo sapiens
ISSIDTDPPADGPSN

SEQ ID NO: 6099 - protein, 15 aa, Homo sapiens
SRTPTRQISSIDTDP

SEQ ID NO: 6100 - protein, 15 aa, Homo sapiens
PMALSRTPTRQISSS

SEQ ID NO: 6101 - protein, 15 aa, Homo sapiens
TRQISSSDTDPPADG

SEQ ID NO: 6102 - protein, 15 aa, Homo sapiens
SSSDTDPPADGPSNP

SEQ ID NO: 6103 - protein, 15 aa, Homo sapiens
RTPTRQISSSDTDPP

SEQ ID NO: 6104 - protein, 15 aa, Homo sapiens
SRTPTRQISSSDTDP

SEQ ID NO: 6105 - protein, 15 aa, Homo sapiens
PMALSRTPTRQIGSS

SEQ ID NO: 6106 - protein, 15 aa, Homo sapiens
TRQIGSSDTDPPADG

SEQ ID NO: 6107 - protein, 15 aa, Homo sapiens
GSSDTDPPADGPSNP

SEQ ID NO: 6108 - protein, 15 aa, Homo sapiens
SRTPTRQIGSSDTDP

SEQ ID NO: 6109 - protein, 15 aa, Homo sapiens
RTPTRQIGSSDTDPP

SEQ ID NO: 6110 - protein, 15 aa, Homo sapiens
ALSRTPTRQIGSSDT

SEQ ID NO: 6111 - protein, 15 aa, Homo sapiens
VVSPAPSRQQALRRA

SEQ ID NO: 6112 - protein, 15 aa, Homo sapiens
SLNCVDDSQDYYVGK

SEQ ID NO: 6113 - protein, 15 aa, Homo sapiens
ILALLPALGLLLWGP

SEQ ID NO: 6114 - protein, 15 aa, Homo sapiens
KAVLLALLMAGLALQ

SEQ ID NO: 6115 - protein, 15 aa, Homo sapiens
MAGLALQPGTALLCY

SEQ ID NO: 6116 - protein, 15 aa, Homo sapiens
AAILALLPALGLLLW

SEQ ID NO: 6117 - protein, 15 aa, Homo sapiens
CSLNCVDDSQDYYVG

SEQ ID NO: 6118 - protein, 15 aa, Homo sapiens
EDCLQVENCTQLGEQ

SEQ ID NO: 6119 - protein, 15 aa, Homo sapiens
VGLLTVISKGCSLNC

SEQ ID NO: 6120 - protein, 15 aa, Homo sapiens
TALLCYSCKAQVSNE

SEQ ID NO: 6121 - protein, 15 aa, Homo sapiens
CLQVENCTQLGEQCW

SEQ ID NO: 6122 - protein, 15 aa, Homo sapiens
LLALLMAGLALQPGT

SEQ ID NO: 6123 - protein, 15 aa, Homo sapiens
MKAVLLALLMAGLAL

SEQ ID NO: 6124 - protein, 15 aa, Homo sapiens
AAAILALLPALGLLL

SEQ ID NO: 6125 - protein, 15 aa, Homo sapiens
GTALLCYSCKAQVSN

SEQ ID NO: 6126 - protein, 15 aa, Homo sapiens
SCKAQVSNEDCLQVE

SEQ ID NO: 6127 - protein, 15 aa, Homo sapiens
LLTVISKGCSLNCVD

SEQ ID NO: 6128 - protein, 15 aa, Homo sapiens
VLLALLMAGLALQPG

SEQ ID NO: 6129 - protein, 15 aa, Homo sapiens
AGLALQPGTALLCYS

SEQ ID NO: 6130 - protein, 15 aa, Homo sapiens
GLALQPGTALLCYSC

SEQ ID NO: 6131 - protein, 15 aa, Homo sapiens
TARIRAVGLLTVISK

SEQ ID NO: 6132 - protein, 15 aa, Homo sapiens
ITCCDTDLCNASGAH

SEQ ID NO: 6133 - protein, 15 aa, Homo sapiens
LALLPALGLLLWGPG

SEQ ID NO: 6134 - protein, 15 aa, Homo sapiens
AVLLALLMAGLALQP

SEQ ID NO: 6135 - protein, 15 aa, Homo sapiens
LALLMAGLALQPGTA

SEQ ID NO: 6136 - protein, 15 aa, Homo sapiens
AQVSNEDCLQVENCT

SEQ ID NO: 6137 - protein, 15 aa, Homo sapiens
CTQLGEQCWTARIRA

SEQ ID NO: 6138 - protein, 15 aa, Homo sapiens
AVGLLTVISKGCSLN

SEQ ID NO: 6139 - protein, 15 aa, Homo sapiens
LTVISKGCSLNCVDD

SEQ ID NO: 6140 - protein, 15 aa, Homo sapiens
KKNITCCDTDLCNAS

SEQ ID NO: 6141 - protein, 15 aa, Homo sapiens
DTDLCNASGAHALQP

SEQ ID NO: 6142 - protein, 15 aa, Homo sapiens
AHALQPAAAILALLP

SEQ ID NO: 6143 - protein, 15 aa, Homo sapiens
PAAAILALLPALGLL

SEQ ID NO: 6144 - protein, 15 aa, Homo sapiens
AILALLPALGLLLWG

SEQ ID NO: 6145 - protein, 15 aa, Homo sapiens
FSTLNPVLRHLFPQE

SEQ ID NO: 6146 - protein, 15 aa, Homo sapiens
CSRLPPSLRCSLHSA

SEQ ID NO: 6147 - protein, 15 aa, Homo sapiens
IGSIDTDPPADGPSN

SEQ ID NO: 6148 - protein, 15 aa, Homo sapiens
TLGVVPQASVPLLTH

SEQ ID NO: 6149 - protein, 15 aa, Homo sapiens
APVPHPDPPMALSRT

SEQ ID NO: 6150 - protein, 15 aa, Homo sapiens
LGVVPQASVPLLTHP

SEQ ID NO: 6151 - protein, 15 aa, Homo sapiens
QPTLGVVPQASVPLL

SEQ ID NO: 6152 - protein, 15 aa, Homo sapiens
AHPIYDLSQVWSVVS

SEQ ID NO: 6153 - protein, 15 aa, Homo sapiens
VPLLTHPAQWEPVLV

SEQ ID NO: 6154 - protein, 15 aa, Homo sapiens
PVLRHLFPQEAFPAH

SEQ ID NO: 6155 - protein, 15 aa, Homo sapiens
QEAFPAHPIYDLSQV

SEQ ID NO: 6156 - protein, 15 aa, Homo sapiens
VLVPEAHPNASLTMY

SEQ ID NO: 6157 - protein, 15 aa, Homo sapiens
CCCFHGPAFSTLNPV

SEQ ID NO: 6158 - protein, 15 aa, Homo sapiens
HGPAFSTLNPVLRHL

SEQ ID NO: 6159 - protein, 15 aa, Homo sapiens
YRLWGAPLQPTLGVV

SEQ ID NO: 6160 - protein, 15 aa, Homo sapiens
SVPLLTHPAQWEPVL

SEQ ID NO: 6161 - protein, 15 aa, Homo sapiens
LLTHPAQWEPVLVPE

SEQ ID NO: 6162 - protein, 15 aa, Homo sapiens
PPSLRCSLHSACCSG

SEQ ID NO: 6163 - protein, 15 aa, Homo sapiens
GAPLQPTLGVVPQAS

SEQ ID NO: 6164 - protein, 15 aa, Homo sapiens
WEPVLVPEAHPNASL

SEQ ID NO: 6165 - protein, 15 aa, Homo sapiens
EPVLVPEAHPNASLT

SEQ ID NO: 6166 - protein, 15 aa, Homo sapiens
PVLVPEAHPNASLTM

SEQ ID NO: 6167 - protein, 15 aa, Homo sapiens
NASLTMYVCAPVPHP

SEQ ID NO: 6168 - protein, 15 aa, Homo sapiens
LNPVLRHLFPQEAFP

SEQ ID NO: 6169 - protein, 15 aa, Homo sapiens
PAHPIYDLSQVWSVV

SEQ ID NO: 6170 - protein, 15 aa, Homo sapiens
CSRLLPSLRCSLHSA

SEQ ID NO: 6171 - protein, 15 aa, Homo sapiens
LPSLRCSLHSACCSG

SEQ ID NO: 6172 - protein, 15 aa, Homo sapiens
SRLWGAPLQPTLGVV

SEQ ID NO: 6173 - protein, 15 aa, Homo sapiens
SSRLWGAPLQPTLGV

SEQ ID NO: 6174 - protein, 15 aa, Homo sapiens
SACCSGDPASSRLWG

SEQ ID NO: 6175 - protein, 15 aa, Homo sapiens
DPASSRLWGAPLQPT

SEQ ID NO: 6176 - protein, 15 aa, Homo sapiens
ACCSGDPASSRLWGA

SEQ ID NO: 6177 - protein, 15 aa, Homo sapiens
CSGDPASSRLWGAPL

SEQ ID NO: 6178 - protein, 15 aa, Homo sapiens
SVPLLTDPAQWEPVL

SEQ ID NO: 6179 - protein, 15 aa, Homo sapiens
TLGVVPQASVPLLTD

SEQ ID NO: 6180 - protein, 15 aa, Homo sapiens
LGVVPQASVPLLTDP

SEQ ID NO: 6181 - protein, 15 aa, Homo sapiens
VPLLTDPAQWEPVLV

SEQ ID NO: 6182 - protein, 15 aa, Homo sapiens
LLTDPAQWEPVLVPE

SEQ ID NO: 6183 - protein, 15 aa, Homo sapiens
QASVPLLTDPAQWEP

SEQ ID NO: 6184 - protein, 15 aa, Homo sapiens
SVPLLTDLAQWEPVL

SEQ ID NO: 6185 - protein, 15 aa, Homo sapiens
LGVVPQASVPLLTDL

SEQ ID NO: 6186 - protein, 15 aa, Homo sapiens
VPLLTDLAQWEPVLV

SEQ ID NO: 6187 - protein, 15 aa, Homo sapiens
LLTDLAQWEPVLVPE

SEQ ID NO: 6188 - protein, 15 aa, Homo sapiens
QASVPLLTDLAQWEP

SEQ ID NO: 6189 - protein, 15 aa, Homo sapiens
LTDLAQWEPVLVPEA

SEQ ID NO: 6190 - protein, 15 aa, Homo sapiens
LGVVPQASVPLLTHL

SEQ ID NO: 6191 - protein, 15 aa, Homo sapiens
VPLLTHLAQWEPVLV

SEQ ID NO: 6192 - protein, 15 aa, Homo sapiens
LLTHLAQWEPVLVPE

SEQ ID NO: 6193 - protein, 15 aa, Homo sapiens
SVPLLTHLAQWEPVL

SEQ ID NO: 6194 - protein, 15 aa, Homo sapiens
QASVPLLTHLAQWEP

SEQ ID NO: 6195 - protein, 15 aa, Homo sapiens
LTHLAQWEPVLVPEA

SEQ ID NO: 6196 - protein, 15 aa, Homo sapiens
VPQASVPLLTHLAQW

SEQ ID NO: 6197 - protein, 15 aa, Homo sapiens
TPVPHPDPPMALSRT

SEQ ID NO: 6198 - protein, 15 aa, Homo sapiens
NASLTMYVCTPVPHP

SEQ ID NO: 6199 - protein, 15 aa, Homo sapiens
SLTMYVCTPVPHPDP

SEQ ID NO: 6200 - protein, 15 aa, Homo sapiens
TMYVCTPVPHPDPPM

SEQ ID NO: 6201 - protein, 15 aa, Homo sapiens
CTPVPHPDPPMALSR

SEQ ID NO: 6202 - protein, 15 aa, Homo sapiens
ISSIDTDPPADGPSN

SEQ ID NO: 6203 - protein, 15 aa, Homo sapiens
DPPMALSRTPTRQIS

SEQ ID NO: 6204 - protein, 15 aa, Homo sapiens
PMALSRTPTRQISSI

SEQ ID NO: 6205 - protein, 15 aa, Homo sapiens
TRQISSIDTDPPADG

SEQ ID NO: 6206 - protein, 15 aa, Homo sapiens
RQISSIDTDPPADGP

SEQ ID NO: 6207 - protein, 15 aa, Homo sapiens
ISSSDTDPPADGPSN

SEQ ID NO: 6208 - protein, 15 aa, Homo sapiens
PMALSRTPTRQISSS

SEQ ID NO: 6209 - protein, 15 aa, Homo sapiens
TRQISSSDTDPPADG

SEQ ID NO: 6210 - protein, 15 aa, Homo sapiens
RQISSSDTDPPADGP

SEQ ID NO: 6211 - protein, 15 aa, Homo sapiens
MALSRTPTRQISSSD

SEQ ID NO: 6212 - protein, 15 aa, Homo sapiens
ALSRTPTRQISSSDT

SEQ ID NO: 6213 - protein, 15 aa, Homo sapiens
IGSSDTDPPADGPSN

SEQ ID NO: 6214 - protein, 15 aa, Homo sapiens
PMALSRTPTRQIGSS

SEQ ID NO: 6215 - protein, 15 aa, Homo sapiens
TRQIGSSDTDPPADG

SEQ ID NO: 6216 - protein, 15 aa, Homo sapiens
RQIGSSDTDPPADGP

SEQ ID NO: 6217 - protein, 15 aa, Homo sapiens
MALSRTPTRQIGSSD

SEQ ID NO: 6218 - protein, 15 aa, Homo sapiens
ALSRTPTRQIGSSDT

SEQ ID NO: 6219 - protein, 15 aa, Homo sapiens
VVSPAPSRQQALRRA

SEQ ID NO: 6220 - protein, 15 aa, Homo sapiens
VSPAPSRQQALRRAQ

SEQ ID NO: 6221 - protein, 15 aa, Homo sapiens
KAVLLALLMAGLALQ

SEQ ID NO: 6222 - protein, 15 aa, Homo sapiens
AVLLALLMAGLALQP

SEQ ID NO: 6223 - protein, 15 aa, Homo sapiens
LLALLMAGLALQPGT

SEQ ID NO: 6224 - protein, 15 aa, Homo sapiens
KAQVSNEDCLQVENC

SEQ ID NO: 6225 - protein, 15 aa, Homo sapiens
EDCLQVENCTQLGEQ

SEQ ID NO: 6226 - protein, 15 aa, Homo sapiens
TARIRAVGLLTVISK

SEQ ID NO: 6227 - protein, 15 aa, Homo sapiens
IRAVGLLTVISKGCS

SEQ ID NO: 6228 - protein, 15 aa, Homo sapiens
AVGLLTVISKGCSLN

SEQ ID NO: 6229 - protein, 15 aa, Homo sapiens
VGLLTVISKGCSLNC

SEQ ID NO: 6230 - protein, 15 aa, Homo sapiens
DTDLCNASGAHALQP

SEQ ID NO: 6231 - protein, 15 aa, Homo sapiens
AHALQPAAAILALLP

SEQ ID NO: 6232 - protein, 15 aa, Homo sapiens
AAILALLPALGLLLW

SEQ ID NO: 6233 - protein, 15 aa, Homo sapiens
ILALLPALGLLLWGP

SEQ ID NO: 6234 - protein, 15 aa, Homo sapiens
LLMAGLALQPGTALL

SEQ ID NO: 6235 - protein, 15 aa, Homo sapiens
NEDCLQVENCTQLGE

SEQ ID NO: 6236 - protein, 15 aa, Homo sapiens
RIRAVGLLTVISKGC

SEQ ID NO: 6237 - protein, 15 aa, Homo sapiens
NASGAHALQPAAAIL

SEQ ID NO: 6238 - protein, 15 aa, Homo sapiens
LLCYSCKAQVSNEDC

SEQ ID NO: 6239 - protein, 15 aa, Homo sapiens
SQDYYVGKKNITCCD

SEQ ID NO: 6240 - protein, 15 aa, Homo sapiens
MKAVLLALLMAGLAL

SEQ ID NO: 6241 - protein, 15 aa, Homo sapiens
ALLMAGLALQPGTAL

SEQ ID NO: 6242 - protein, 15 aa, Homo sapiens
MAGLALQPGTALLCY

SEQ ID NO: 6243 - protein, 15 aa, Homo sapiens
GTALLCYSCKAQVSN

SEQ ID NO: 6244 - protein, 15 aa, Homo sapiens
TALLCYSCKAQVSNE

SEQ ID NO: 6245 - protein, 15 aa, Homo sapiens
CLQVENCTQLGEQCW

SEQ ID NO: 6246 - protein, 15 aa, Homo sapiens
LTVISKGCSLNCVDD

SEQ ID NO: 6247 - protein, 15 aa, Homo sapiens
GCSLNCVDDSQDYYV

SEQ ID NO: 6248 - protein, 15 aa, Homo sapiens
LNCVDDSQDYYVGKK

SEQ ID NO: 6249 - protein, 15 aa, Homo sapiens
KKNITCCDTDLCNAS

SEQ ID NO: 6250 - protein, 15 aa, Homo sapiens
AAAILALLPALGLLL

SEQ ID NO: 6251 - protein, 15 aa, Homo sapiens
LALLPALGLLLWGPG

SEQ ID NO: 6252 - protein, 15 aa, Homo sapiens
LMAGLALQPGTALLC

SEQ ID NO: 6253 - protein, 15 aa, Homo sapiens
AGLALQPGTALLCYS

SEQ ID NO: 6254 - protein, 15 aa, Homo sapiens
ALQPGTALLCYSCKA

SEQ ID NO: 6255 - protein, 15 aa, Homo sapiens
QPGTALLCYSCKAQV

SEQ ID NO: 6256 - protein, 15 aa, Homo sapiens
PGTALLCYSCKAQVS

SEQ ID NO: 6257 - protein, 15 aa, Homo sapiens
YSCKAQVSNEDCLQV

SEQ ID NO: 6258 - protein, 15 aa, Homo sapiens
QVSNEDCLQVENCTQ

SEQ ID NO: 6259 - protein, 15 aa, Homo sapiens
ENCTQLGEQCWTARI

SEQ ID NO: 6260 - protein, 15 aa, Homo sapiens
NCTQLGEQCWTARIR

SEQ ID NO: 6261 - protein, 15 aa, Homo sapiens
TQLGEQCWTARIRAV

SEQ ID NO: 6262 - protein, 15 aa, Homo sapiens
LGEQCWTARIRAVGL

SEQ ID NO: 6263 - protein, 15 aa, Homo sapiens
GEQCWTARIRAVGLL

SEQ ID NO: 6264 - protein, 15 aa, Homo sapiens
QCWTARIRAVGLLTV

SEQ ID NO: 6265 - protein, 15 aa, Homo sapiens
WTARIRAVGLLTVIS

SEQ ID NO: 6266 - protein, 15 aa, Homo sapiens
CSLNCVDDSQDYYVG

SEQ ID NO: 6267 - protein, 15 aa, Homo sapiens
SLNCVDDSQDYYVGK

SEQ ID NO: 6268 - protein, 15 aa, Homo sapiens
CVDDSQDYYVGKKNI

SEQ ID NO: 6269 - protein, 15 aa, Homo sapiens
DSQDYYVGKKNITCC

SEQ ID NO: 6270 - protein, 15 aa, Homo sapiens
YVGKKNITCCDTDLC

SEQ ID NO: 6271 - protein, 15 aa, Homo sapiens
KNITCCDTDLCNASG

SEQ ID NO: 6272 - protein, 15 aa, Homo sapiens
ITCCDTDLCNASGAH

SEQ ID NO: 6273 - protein, 15 aa, Homo sapiens
TCCDTDLCNASGAHA

SEQ ID NO: 6274 - protein, 15 aa, Homo sapiens
DLCNASGAHALQPAA

SEQ ID NO: 6275 - protein, 15 aa, Homo sapiens
ASGAHALQPAAAILA

SEQ ID NO: 6276 - protein, 15 aa, Homo sapiens
HALQPAAAILALLPA

SEQ ID NO: 6277 - protein, 15 aa, Homo sapiens
ALQPAAAILALLPAL

SEQ ID NO: 6278 - protein, 15 aa, Homo sapiens
QPAAAILALLPALGL

SEQ ID NO: 6279 - protein, 15 aa, Homo sapiens
PAAAILALLPALGLL

SEQ ID NO: 6280 - protein, 15 aa, Homo sapiens
EQCWTARIRAVGLLT

SEQ ID NO: 6281 - protein, 15 aa, Homo sapiens
QDYYVGKKNITCCDT

SEQ ID NO: 6282 - protein, 15 aa, Homo sapiens
LLTVISKGCSLNCVD

SEQ ID NO: 6283 - protein, 15 aa, Homo sapiens
QPTLGVVPQASVPLL

SEQ ID NO: 6284 - protein, 15 aa, Homo sapiens
QASVPLLTHPAQWEP

SEQ ID NO: 6285 - protein, 15 aa, Homo sapiens
EPVLVPEAHPNASLT

SEQ ID NO: 6286 - protein, 15 aa, Homo sapiens
AHPIYDLSQVWSVVS

SEQ ID NO: 6287 - protein, 15 aa, Homo sapiens
IYDLSQVWSVVSPAP

SEQ ID NO: 6288 - protein, 15 aa, Homo sapiens
WSVVSPAPSRGQALR

SEQ ID NO: 6289 - protein, 15 aa, Homo sapiens
YRLWGAPLQPTLGVV

SEQ ID NO: 6290 - protein, 15 aa, Homo sapiens
PAQWEPVLVPEAHPN

SEQ ID NO: 6291 - protein, 15 aa, Homo sapiens
SQVWSVVSPAPSRGQ

SEQ ID NO: 6292 - protein, 15 aa, Homo sapiens
CSRLPPSLRCSLHSA

SEQ ID NO: 6293 - protein, 15 aa, Homo sapiens
SYRLWGAPLQPTLGV

SEQ ID NO: 6294 - protein, 15 aa, Homo sapiens
TLGVVPQASVPLLTH

SEQ ID NO: 6295 - protein, 15 aa, Homo sapiens
LGVVPQASVPLLTHP

SEQ ID NO: 6296 - protein, 15 aa, Homo sapiens
PVLVPEAHPNASLTM

SEQ ID NO: 6297 - protein, 15 aa, Homo sapiens
PMALSRTPTRQIGSI

SEQ ID NO: 6298 - protein, 15 aa, Homo sapiens
TRQIGSIDTDPPADG

SEQ ID NO: 6299 - protein, 15 aa, Homo sapiens
SNPLCCCFHGPAFST

SEQ ID NO: 6300 - protein, 15 aa, Homo sapiens
FSTLNPVLRHLFPQE

SEQ ID NO: 6301 - protein, 15 aa, Homo sapiens
NPVLRHLFPQEAFPA

SEQ ID NO: 6302 - protein, 15 aa, Homo sapiens
LSQVWSVVSPAPSRG

SEQ ID NO: 6303 - protein, 15 aa, Homo sapiens
PQASVPLLTHPAQWE

SEQ ID NO: 6304 - protein, 15 aa, Homo sapiens
PDPPMALSRTPTRQI

SEQ ID NO: 6305 - protein, 15 aa, Homo sapiens
RTPTRQIGSIDTDPP

SEQ ID NO: 6306 - protein, 15 aa, Homo sapiens
CCFHGPAFSTLNPVL

SEQ ID NO: 6307 - protein, 15 aa, Homo sapiens
TTTWARRTSRAVTPT

SEQ ID NO: 6308 - protein, 15 aa, Homo sapiens
PASYRLWGAPLQPTL

SEQ ID NO: 6309 - protein, 15 aa, Homo sapiens
LTMYVCAPVPHPDPP

SEQ ID NO: 6310 - protein, 15 aa, Homo sapiens
CCCFHGPAFSTLNPV

SEQ ID NO: 6311 - protein, 15 aa, Homo sapiens
GPAFSTLNPVLRHLF

SEQ ID NO: 6312 - protein, 15 aa, Homo sapiens
RHLFPQEAFPAHPIY

SEQ ID NO: 6313 - protein, 15 aa, Homo sapiens
QEAFPAHPIYDLSQV

SEQ ID NO: 6314 - protein, 15 aa, Homo sapiens
HPIYDLSQVWSVVSP

SEQ ID NO: 6315 - protein, 15 aa, Homo sapiens
SRAVTPTCATPAGPM

SEQ ID NO: 6316 - protein, 15 aa, Homo sapiens
AGPMPCSRLPPSLRC

SEQ ID NO: 6317 - protein, 15 aa, Homo sapiens
PPSLRCSLHSACCSG

SEQ ID NO: 6318 - protein, 15 aa, Homo sapiens
RCSLHSACCSGDPAS

SEQ ID NO: 6319 - protein, 15 aa, Homo sapiens
VPLLTHPAQWEPVLV

SEQ ID NO: 6320 - protein, 15 aa, Homo sapiens
WEPVLVPEAHPNASL

SEQ ID NO: 6321 - protein, 15 aa, Homo sapiens
NASLTMYVCAPVPHP

SEQ ID NO: 6322 - protein, 15 aa, Homo sapiens
CAPVPHPDPPMALSR

SEQ ID NO: 6323 - protein, 15 aa, Homo sapiens
DPPMALSRTPTRQIG

SEQ ID NO: 6324 - protein, 15 aa, Homo sapiens
IGSIDTDPPADGPSN

SEQ ID NO: 6325 - protein, 15 aa, Homo sapiens
LRHLFPQEAFPAHPI

SEQ ID NO: 6326 - protein, 15 aa, Homo sapiens
THRTTTWARRTSRAV

SEQ ID NO: 6327 - protein, 15 aa, Homo sapiens
HRTTTWARRTSRAVT

SEQ ID NO: 6328 - protein, 15 aa, Homo sapiens
TTWARRTSRAVTPTC

SEQ ID NO: 6329 - protein, 15 aa, Homo sapiens
ARRTSRAVTPTCATP

SEQ ID NO: 6330 - protein, 15 aa, Homo sapiens
RRTSRAVTPTCATPA

SEQ ID NO: 6331 - protein, 15 aa, Homo sapiens
RTSRAVTPTCATPAG

SEQ ID NO: 6332 - protein, 15 aa, Homo sapiens
PSLRCSLHSACCSGD

SEQ ID NO: 6333 - protein, 15 aa, Homo sapiens
ACCSGDPASYRLWGA

SEQ ID NO: 6334 - protein, 15 aa, Homo sapiens
DPASYRLWGAPLQPT

SEQ ID NO: 6335 - protein, 15 aa, Homo sapiens
LWGAPLQPTLGVVPQ

SEQ ID NO: 6336 - protein, 15 aa, Homo sapiens
APLQPTLGVVPQASV

SEQ ID NO: 6337 - protein, 15 aa, Homo sapiens
LQPTLGVVPQASVPL

SEQ ID NO: 6338 - protein, 15 aa, Homo sapiens
PLLTHPAQWEPVLVP

SEQ ID NO: 6339 - protein, 15 aa, Homo sapiens
VLVPEAHPNASLTMY

SEQ ID NO: 6340 - protein, 15 aa, Homo sapiens
VPEAHPNASLTMYVC

SEQ ID NO: 6341 - protein, 15 aa, Homo sapiens
EAHPNASLTMYVCAP

SEQ ID NO: 6342 - protein, 15 aa, Homo sapiens
MYVCAPVPHPDPPMA

SEQ ID NO: 6343 - protein, 15 aa, Homo sapiens
APVPHPDPPMALSRT

SEQ ID NO: 6344 - protein, 15 aa, Homo sapiens
HPDPPMALSRTPTRQ

SEQ ID NO: 6345 - protein, 15 aa, Homo sapiens
ALSRTPTRQIGSIDT

SEQ ID NO: 6346 - protein, 15 aa, Homo sapiens
RQIGSIDTDPPADGP

SEQ ID NO: 6347 - protein, 15 aa, Homo sapiens
IDTDPPADGPSNPLC

SEQ ID NO: 6348 - protein, 15 aa, Homo sapiens
TDPPADGPSNPLCCC

SEQ ID NO: 6349 - protein, 15 aa, Homo sapiens
CFHGPAFSTLNPVLR

SEQ ID NO: 6350 - protein, 15 aa, Homo sapiens
HGPAFSTLNPVLRHL

SEQ ID NO: 6351 - protein, 15 aa, Homo sapiens
STLNPVLRHLFPQEA

SEQ ID NO: 6352 - protein, 15 aa, Homo sapiens
PVLRHLFPQEAFPAH

SEQ ID NO: 6353 - protein, 15 aa, Homo sapiens
LFPQEAFPAHPIYDL

SEQ ID NO: 6354 - protein, 15 aa, Homo sapiens
AFPAHPIYDLSQVWS

SEQ ID NO: 6355 - protein, 15 aa, Homo sapiens
PAHPIYDLSQVWSVV

SEQ ID NO: 6356 - protein, 15 aa, Homo sapiens
SVVSPAPSRGQALRR

SEQ ID NO: 6357 - protein, 15 aa, Homo sapiens
CSRLLPSLRCSLHSA

SEQ ID NO: 6358 - protein, 15 aa, Homo sapiens
AGPMPCSRLLPSLRC

SEQ ID NO: 6359 - protein, 15 aa, Homo sapiens
SRLLPSLRCSLHSAC

SEQ ID NO: 6360 - protein, 15 aa, Homo sapiens
LPSLRCSLHSACCSG

SEQ ID NO: 6361 - protein, 15 aa, Homo sapiens
TPAGPMPCSRLLPSL

SEQ ID NO: 6362 - protein, 15 aa, Homo sapiens
MPCSRLLPSLRCSLH

SEQ ID NO: 6363 - protein, 15 aa, Homo sapiens
SRLWGAPLQPTLGVV

SEQ ID NO: 6364 - protein, 15 aa, Homo sapiens
SSRLWGAPLQPTLGV

SEQ ID NO: 6365 - protein, 15 aa, Homo sapiens
ACCSGDPASSRLWGA

SEQ ID NO: 6366 - protein, 15 aa, Homo sapiens
CCSGDPASSRLWGAP

SEQ ID NO: 6367 - protein, 15 aa, Homo sapiens
DPASSRLWGAPLQPT

SEQ ID NO: 6368 - protein, 15 aa, Homo sapiens
TLGVVPQASVPLLTD

SEQ ID NO: 6369 - protein, 15 aa, Homo sapiens
LGVVPQASVPLLTDP

SEQ ID NO: 6370 - protein, 15 aa, Homo sapiens
QASVPLLTDPAQWEP

SEQ ID NO: 6371 - protein, 15 aa, Homo sapiens
PQASVPLLTDPAQWE

SEQ ID NO: 6372 - protein, 15 aa, Homo sapiens
SVPLLTDPAQWEPVL

SEQ ID NO: 6373 - protein, 15 aa, Homo sapiens
VPLLTDPAQWEPVLV

SEQ ID NO: 6374 - protein, 15 aa, Homo sapiens
PLLTDPAQWEPVLVP

SEQ ID NO: 6375 - protein, 15 aa, Homo sapiens
LGVVPQASVPLLTDL

SEQ ID NO: 6376 - protein, 15 aa, Homo sapiens
QASVPLLTDLAQWEP

SEQ ID NO: 6377 - protein, 15 aa, Homo sapiens
VPLLTDLAQWEPVLV

SEQ ID NO: 6378 - protein, 15 aa, Homo sapiens
PQASVPLLTDLAQWE

SEQ ID NO: 6379 - protein, 15 aa, Homo sapiens
SVPLLTDLAQWEPVL

SEQ ID NO: 6380 - protein, 15 aa, Homo sapiens
LTDLAQWEPVLVPEA

SEQ ID NO: 6381 - protein, 15 aa, Homo sapiens
PLLTDLAQWEPVLVP

SEQ ID NO: 6382 - protein, 15 aa, Homo sapiens
QASVPLLTHLAQWEP

SEQ ID NO: 6383 - protein, 15 aa, Homo sapiens
LAQWEPVLVPEAHPN

SEQ ID NO: 6384 - protein, 15 aa, Homo sapiens
LGVVPQASVPLLTHL

SEQ ID NO: 6385 - protein, 15 aa, Homo sapiens
VPLLTHLAQWEPVLV

SEQ ID NO: 6386 - protein, 15 aa, Homo sapiens
PQASVPLLTHLAQWE

SEQ ID NO: 6387 - protein, 15 aa, Homo sapiens
LTHLAQWEPVLVPEA

SEQ ID NO: 6388 - protein, 15 aa, Homo sapiens
PLLTHLAQWEPVLVP

SEQ ID NO: 6389 - protein, 15 aa, Homo sapiens
NASLTMYVCTPVPHP

SEQ ID NO: 6390 - protein, 15 aa, Homo sapiens
CTPVPHPDPPMALSR

SEQ ID NO: 6391 - protein, 15 aa, Homo sapiens
EAHPNASLTMYVCTP

SEQ ID NO: 6392 - protein, 15 aa, Homo sapiens
ASLTMYVCTPVPHPD

SEQ ID NO: 6393 - protein, 15 aa, Homo sapiens
MYVCTPVPHPDPPMA

SEQ ID NO: 6394 - protein, 15 aa, Homo sapiens
TPVPHPDPPMALSRT

SEQ ID NO: 6395 - protein, 15 aa, Homo sapiens
LTMYVCTPVPHPDPP

SEQ ID NO: 6396 - protein, 15 aa, Homo sapiens
SLTMYVCTPVPHPDP

SEQ ID NO: 6397 - protein, 15 aa, Homo sapiens
TMYVCTPVPHPDPPM

SEQ ID NO: 6398 - protein, 15 aa, Homo sapiens
PEAHPNASLTMYVCT

SEQ ID NO: 6399 - protein, 15 aa, Homo sapiens
AHPNASLTMYVCTPV

SEQ ID NO: 6400 - protein, 15 aa, Homo sapiens
HPNASLTMYVCTPVP

SEQ ID NO: 6401 - protein, 15 aa, Homo sapiens
VCTPVPHPDPPMALS

SEQ ID NO: 6402 - protein, 15 aa, Homo sapiens
PMALSRTPTRQISSI

SEQ ID NO: 6403 - protein, 15 aa, Homo sapiens
TRQISSIDTDPPADG

SEQ ID NO: 6404 - protein, 15 aa, Homo sapiens
RTPTRQISSIDTDPP

SEQ ID NO: 6405 - protein, 15 aa, Homo sapiens
DPPMALSRTPTRQIS

SEQ ID NO: 6406 - protein, 15 aa, Homo sapiens
ISSIDTDPPADGPSN

SEQ ID NO: 6407 - protein, 15 aa, Homo sapiens
MALSRTPTRQISSID

SEQ ID NO: 6408 - protein, 15 aa, Homo sapiens
ALSRTPTRQISSIDT

SEQ ID NO: 6409 - protein, 15 aa, Homo sapiens
RQISSIDTDPPADGP

SEQ ID NO: 6410 - protein, 15 aa, Homo sapiens
PMALSRTPTRQISSS

SEQ ID NO: 6411 - protein, 15 aa, Homo sapiens
RTPTRQISSSDTDPP

SEQ ID NO: 6412 - protein, 15 aa, Homo sapiens
TRQISSSDTDPPADG

SEQ ID NO: 6413 - protein, 15 aa, Homo sapiens
MALSRTPTRQISSSD

SEQ ID NO: 6414 - protein, 15 aa, Homo sapiens
ALSRTPTRQISSSDT

SEQ ID NO: 6415 - protein, 15 aa, Homo sapiens
RQISSSDTDPPADGP

SEQ ID NO: 6416 - protein, 15 aa, Homo sapiens
PMALSRTPTRQIGSS

SEQ ID NO: 6417 - protein, 15 aa, Homo sapiens
RTPTRQIGSSDTDPP

SEQ ID NO: 6418 - protein, 15 aa, Homo sapiens
TRQIGSSDTDPPADG

SEQ ID NO: 6419 - protein, 15 aa, Homo sapiens
ALSRTPTRQIGSSDT

SEQ ID NO: 6420 - protein, 15 aa, Homo sapiens
RQIGSSDTDPPADGP

SEQ ID NO: 6421 - protein, 15 aa, Homo sapiens
SDTDPPADGPSNPLC

SEQ ID NO: 6422 - protein, 15 aa, Homo sapiens
VVSPAPSRQQALRRA

SEQ ID NO: 6423 - protein, 15 aa, Homo sapiens
VGLLTVISKGCSLNC

SEQ ID NO: 6424 - protein, 15 aa, Homo sapiens
EQCWTARIRAVGLLT

SEQ ID NO: 6425 - protein, 15 aa, Homo sapiens
SQDYYVGKKNITCCD

SEQ ID NO: 6426 - protein, 15 aa, Homo sapiens
AVLLALLMAGLALQP

SEQ ID NO: 6427 - protein, 15 aa, Homo sapiens
AAAILALLPALGLLL

SEQ ID NO: 6428 - protein, 15 aa, Homo sapiens
ALLMAGLALQPGTAL

SEQ ID NO: 6429 - protein, 15 aa, Homo sapiens
LGEQCWTARIRAVGL

SEQ ID NO: 6430 - protein, 15 aa, Homo sapiens
TALLCYSCKAQVSNE

SEQ ID NO: 6431 - protein, 15 aa, Homo sapiens
DSQDYYVGKKNITCC

SEQ ID NO: 6432 - protein, 15 aa, Homo sapiens
TCCDTDLCNASGAHA

SEQ ID NO: 6433 - protein, 15 aa, Homo sapiens
SQVWSVVSPAPSRGQ

SEQ ID NO: 6434 - protein, 15 aa, Homo sapiens
PAQWEPVLVPEAHPN

SEQ ID NO: 6435 - protein, 15 aa, Homo sapiens
FSTLNPVLRHLFPQE

SEQ ID NO: 6436 - protein, 15 aa, Homo sapiens
STLNPVLRHLFPQEA

SEQ ID NO: 6437 - protein, 15 aa, Homo sapiens
QASVPLLTHPAQWEP

SEQ ID NO: 6438 - protein, 15 aa, Homo sapiens
EPVLVPEAHPNASLT

SEQ ID NO: 6439 - protein, 15 aa, Homo sapiens
MYVCAPVPHPDPPMA

SEQ ID NO: 6440 - protein, 15 aa, Homo sapiens
SNPLCCCFHGPAFST

SEQ ID NO: 6441 - protein, 15 aa, Homo sapiens
LSQVWSVVSPAPSRG

SEQ ID NO: 6442 - protein, 15 aa, Homo sapiens
IYDLSQVWSVVSPAP

SEQ ID NO: 6443 - protein, 15 aa, Homo sapiens
TRQIGSIDTDPPADG

SEQ ID NO: 6444 - protein, 15 aa, Homo sapiens
NPVLRHLFPQEAFPA

SEQ ID NO: 6445 - protein, 15 aa, Homo sapiens
AHPIYDLSQVWSVVS

SEQ ID NO: 6446 - protein, 15 aa, Homo sapiens
THRTTTWARRTSRAV

SEQ ID NO: 6447 - protein, 15 aa, Homo sapiens
GPAFSTLNPVLRHLF

SEQ ID NO: 6448 - protein, 15 aa, Homo sapiens
LTMYVCAPVPHPDPP

SEQ ID NO: 6449 - protein, 15 aa, Homo sapiens
MALSRTPTRQIGSID

SEQ ID NO: 6450 - protein, 15 aa, Homo sapiens
SRAVTPTCATPAGPM

SEQ ID NO: 6451 - protein, 15 aa, Homo sapiens
PAGPMPCSRLPPSLR

SEQ ID NO: 6452 - protein, 15 aa, Homo sapiens
CSRLPPSLRCSLHSA

SEQ ID NO: 6453 - protein, 15 aa, Homo sapiens
PPSLRCSLHSACCSG

SEQ ID NO: 6454 - protein, 15 aa, Homo sapiens
CSGDPASYRLWGAPL

SEQ ID NO: 6455 - protein, 15 aa, Homo sapiens
LQPTLGVVPQASVPL

SEQ ID NO: 6456 - protein, 15 aa, Homo sapiens
VPLLTHPAQWEPVLV

SEQ ID NO: 6457 - protein, 15 aa, Homo sapiens
PDPPMALSRTPTRQI

SEQ ID NO: 6458 - protein, 15 aa, Homo sapiens
VWSVVSPAPSRGQAL

SEQ ID NO: 6459 - protein, 15 aa, Homo sapiens
SVVSPAPSRGQALRR

SEQ ID NO: 6460 - protein, 15 aa, Homo sapiens
RLWGAPLQPTLGVVP

SEQ ID NO: 6461 - protein, 15 aa, Homo sapiens
GAPLQPTLGVVPQAS

SEQ ID NO: 6462 - protein, 15 aa, Homo sapiens
QPTLGVVPQASVPLL

SEQ ID NO: 6463 - protein, 15 aa, Homo sapiens
ASLTMYVCAPVPHPD

SEQ ID NO: 6464 - protein, 15 aa, Homo sapiens
LRHLFPQEAFPAHPI

SEQ ID NO: 6465 - protein, 15 aa, Homo sapiens
RRTSRAVTPTCATPA

SEQ ID NO: 6466 - protein, 15 aa, Homo sapiens
AGPMPCSRLPPSLRC

SEQ ID NO: 6467 - protein, 15 aa, Homo sapiens
PQASVPLLTHPAQWE

SEQ ID NO: 6468 - protein, 15 aa, Homo sapiens
QWEPVLVPEAHPNAS

SEQ ID NO: 6469 - protein, 15 aa, Homo sapiens
PVLVPEAHPNASLTM

SEQ ID NO: 6470 - protein, 15 aa, Homo sapiens
PNASLTMYVCAPVPH

SEQ ID NO: 6471 - protein, 15 aa, Homo sapiens
CAPVPHPDPPMALSR

SEQ ID NO: 6472 - protein, 15 aa, Homo sapiens
IGSIDTDPPADGPSN

SEQ ID NO: 6473 - protein, 15 aa, Homo sapiens
TTTWARRTSRAVTPT

SEQ ID NO: 6474 - protein, 15 aa, Homo sapiens
PASYRLWGAPLQPTL

SEQ ID NO: 6475 - protein, 15 aa, Homo sapiens
PAGPMPCSRLLPSLR

SEQ ID NO: 6476 - protein, 15 aa, Homo sapiens
CSRLLPSLRCSLHSA

SEQ ID NO: 6477 - protein, 15 aa, Homo sapiens
LPSLRCSLHSACCSG

SEQ ID NO: 6478 - protein, 15 aa, Homo sapiens
SRLLPSLRCSLHSAC

SEQ ID NO: 6479 - protein, 15 aa, Homo sapiens
AGPMPCSRLLPSLRC

SEQ ID NO: 6480 - protein, 15 aa, Homo sapiens
ATPAGPMPCSRLLPS

SEQ ID NO: 6481 - protein, 15 aa, Homo sapiens
MPCSRLLPSLRCSLH

SEQ ID NO: 6482 - protein, 15 aa, Homo sapiens
PMPCSRLLPSLRCSL

SEQ ID NO: 6483 - protein, 15 aa, Homo sapiens
PCSRLLPSLRCSLHS

SEQ ID NO: 6484 - protein, 15 aa, Homo sapiens
CSGDPASSRLWGAPL

SEQ ID NO: 6485 - protein, 15 aa, Homo sapiens
SRLWGAPLQPTLGVV

SEQ ID NO: 6486 - protein, 15 aa, Homo sapiens
CSLHSACCSGDPASS

SEQ ID NO: 6487 - protein, 15 aa, Homo sapiens
SLHSACCSGDPASSR

SEQ ID NO: 6488 - protein, 15 aa, Homo sapiens
LHSACCSGDPASSRL

SEQ ID NO: 6489 - protein, 15 aa, Homo sapiens
HSACCSGDPASSRLW

SEQ ID NO: 6490 - protein, 15 aa, Homo sapiens
SGDPASSRLWGAPLQ

SEQ ID NO: 6491 - protein, 15 aa, Homo sapiens
GDPASSRLWGAPLQP

SEQ ID NO: 6492 - protein, 15 aa, Homo sapiens
DPASSRLWGAPLQPT

SEQ ID NO: 6493 - protein, 15 aa, Homo sapiens
ASSRLWGAPLQPTLG

SEQ ID NO: 6494 - protein, 15 aa, Homo sapiens
SSRLWGAPLQPTLGV

SEQ ID NO: 6495 - protein, 15 aa, Homo sapiens
VPLLTDPAQWEPVLV

SEQ ID NO: 6496 - protein, 15 aa, Homo sapiens
PQASVPLLTDPAQWE

SEQ ID NO: 6497 - protein, 15 aa, Homo sapiens
QASVPLLTDPAQWEP

SEQ ID NO: 6498 - protein, 15 aa, Homo sapiens
LGVVPQASVPLLTDP

SEQ ID NO: 6499 - protein, 15 aa, Homo sapiens
VPQASVPLLTDPAQW

SEQ ID NO: 6500 - protein, 15 aa, Homo sapiens
TDPAQWEPVLVPEAH

SEQ ID NO: 6501 - protein, 15 aa, Homo sapiens
TLGVVPQASVPLLTD

SEQ ID NO: 6502 - protein, 15 aa, Homo sapiens
VVPQASVPLLTDPAQ

SEQ ID NO: 6503 - protein, 15 aa, Homo sapiens
SVPLLTDPAQWEPVL

SEQ ID NO: 6504 - protein, 15 aa, Homo sapiens
VPLLTDLAQWEPVLV

SEQ ID NO: 6505 - protein, 15 aa, Homo sapiens
PQASVPLLTDLAQWE

SEQ ID NO: 6506 - protein, 15 aa, Homo sapiens
QASVPLLTDLAQWEP

SEQ ID NO: 6507 - protein, 15 aa, Homo sapiens
LAQWEPVLVPEAHPN

SEQ ID NO: 6508 - protein, 15 aa, Homo sapiens
QASVPLLTHLAQWEP

SEQ ID NO: 6509 - protein, 15 aa, Homo sapiens
VPLLTHLAQWEPVLV

SEQ ID NO: 6510 - protein, 15 aa, Homo sapiens
PQASVPLLTHLAQWE

SEQ ID NO: 6511 - protein, 15 aa, Homo sapiens
MYVCTPVPHPDPPMA

SEQ ID NO: 6512 - protein, 15 aa, Homo sapiens
LTMYVCTPVPHPDPP

SEQ ID NO: 6513 - protein, 15 aa, Homo sapiens
ASLTMYVCTPVPHPD

SEQ ID NO: 6514 - protein, 15 aa, Homo sapiens
PNASLTMYVCTPVPH

SEQ ID NO: 6515 - protein, 15 aa, Homo sapiens
CTPVPHPDPPMALSR

SEQ ID NO: 6516 - protein, 15 aa, Homo sapiens
NASLTMYVCTPVPHP

SEQ ID NO: 6517 - protein, 15 aa, Homo sapiens
TRQISSIDTDPPADG

SEQ ID NO: 6518 - protein, 15 aa, Homo sapiens
MALSRTPTRQISSID

SEQ ID NO: 6519 - protein, 15 aa, Homo sapiens
ISSIDTDPPADGPSN

SEQ ID NO: 6520 - protein, 15 aa, Homo sapiens
ALSRTPTRQISSIDT

SEQ ID NO: 6521 - protein, 15 aa, Homo sapiens
SSIDTDPPADGPSNP

SEQ ID NO: 6522 - protein, 15 aa, Homo sapiens
MALSRTPTRQISSSD

SEQ ID NO: 6523 - protein, 15 aa, Homo sapiens
TRQISSSDTDPPADG

SEQ ID NO: 6524 - protein, 15 aa, Homo sapiens
ALSRTPTRQISSSDT

SEQ ID NO: 6525 - protein, 15 aa, Homo sapiens
SSSDTDPPADGPSNP

SEQ ID NO: 6526 - protein, 15 aa, Homo sapiens
PMALSRTPTRQISSS

SEQ ID NO: 6527 - DNA, 1020 bp, Homo sapiens
tttgaggccatataaagtcacctgaggccctctccaccacagcccaccagtgaccatgaaggctgtgctgcttgccctgttgatggcaggcttggccctgcagccaggcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgccgccatccttgcgctgctccctgcactcggcctgctgctctggggacccggccagctataggctctggggggccccgctgcagcccacactgggtgtggtgccccaggcctctgtgccactcctcacacacccggcccagtgggagcctgtcctggttcctgaggcacatcctaacgcaagtctgaccatgtatgtctgcgcccctgtcccccaccctgaccctcccatggccctctccaggactcccacccggcagatcggctctattgacacagatccgcctgcagatggcccctccaaccctctctgctgctgtttccatggcccagcattctccacccttaaccctgtgctcaggcacctcttcccccaggaagccttccctgcccaccccatctatgacttgagccaggtctggtccgtggtgtcccccgcacccagcaggggacaggcactcaggagggcccggtaaaggctgagatgaagtggactgagtagaactggaggacaggagtcgacgtgagttcctgggagtctccagagatggggcctggaggcctggaggaaggggccaggcctcacattcgtggggctccctgaatggcagcctcagcacagcgtaggcccttaataaacacctgttggataagcca

SEQ ID NO: 6528 - DNA, 1005 bp, Homo sapiens
agtcacctgaggccctctccaccacagcccaccagtgaccatgaaggctgtgctgcttgccctgttgatggcaggcttggccctgcagccaggcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgccgccatccttgcgctgctccctgcactcggcctgctgctctggggacccggccagctataggctctggggggccccgctgcagcccacactgggtgtggtgccccaggcctctgtgccactcctcacacacccggcccagtgggagcctgtcctggttcctgaggcacatcctaacgcaagtctgaccatgtatgtctgcgcccctgtcccccaccctgaccctcccatggccctctccaggactcccacccggcagatcggctctattgacacagatccgcctgcagatggcccctccaaccctctctgctgctgtttccatggcccagcattctccacccttaaccctgtgctcaggcacctcttcccccaggaagccttccctgcccaccccatctatgacttgagccaggtctggtccgtggtgtcccccgcacccagcaggggacaggcactcaggagggcccggtaaaggctgagatgaagtggactgagtagaactggaggacaggagtcgacgtgagttcctgggagtctccagagatggggcctggaggcctggaggaaggggccaggcctcacattcgtggggctccctgaatggcagcctcagcacagcgtaggcccttaataaacacctgttggataagcca

SEQ ID NO: 6529 - DNA, 985 bp, Homo sapiens
  misc_feature (0)...(0): n = a,c,t,or g
agggagaggcagtgaccatgaaggctgtgctgcttgccctgttgatggcaggcttggccctgcagccaggcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgccgccatccttgcgctgctccctgcactcggcctgctgctctggggacccggccagctataggctctggggggccccgctgcagcccacactgggtgtggtgccccaggcctttgtgccactcctcacagaacctggcccagtgggagcctgtcctggttcctgaggcacatcctaacgcaagtttgaccatgtatgtttgcaccccttttccccnaaccctgaccttcccatgggccttttccaggattcccacccggcagatcagttttagtgacacagatccgcctgcagatggcccctccaaccctttctgttgctgtttccatggcccagcattttccacccttaaccctgtgttcaggcacttcttcccccaggaagccttccctgcccaccccatttatgaattgagccaggtttggtccgtggtgtcccccgcacccagcaggggacaggcaatcaggagggcccagtaaaggctgagatgaagtggactgagtagaactggaggacaagagttgacgtgagttcctgggagtttccagagatggggcctggaggcctggaggaaggggccaggcctcacatttgtggggctcccgaatggcagcctgagcacagcgtaggcccttaataaacacctgttggataagcca

SEQ ID NO: 6530 - protein, 123 aa, Homo sapiens; identical to SEQ ID NO: 150

SEQ ID NO: 6531 - protein, 123 aa, Homo sapiens; identical to SEQ ID NO: 150

SEQ ID NO: 6532 - protein, 123 aa, Homo sapiens; identical to SEQ ID NO: 150

SEQ ID NO: 6533 - DNA, 888 bp, Homo sapiens
tttgaggccatataaagtcacctgaggccctctccaccacagcccaccagtgaccatgaaggctgtgctgcttgccctgttgatggcaggcttggccctgcagccaggcactgccctgctgtgctactcctgcaaagcccaggcgcagttggcctcctgaccgtcatcagcaaaggctgcagcttgaactgcgtggatgactcacaggactactacgtgggcaagaagaacatcacgtgctgtgacaccgacttgtgcactcggcctgctgctctggggacccggccagctataggctctggggggccccgctgcagcccacactgggtgtggtgccccaggcctctgtgccactcctcacacacccggcccagtgggagcctgtcctggttcctgaggcacatcctaacgcaagtctgaccatgtatgtctgcgcccctgtcccccaccctgaccctcccatggccctctccaggactcccacccggcagatcggctctattgacacagatccgcctgcagatggcccctccaaccctctctgctgctgtttccatggcccagcattctccacccttaaccctgtgctcaggcacctcttcccccaggaagccttccctgcccaccccatctatgacttgagccaggtctggtccgtggtgtcccccgcacccagcaggggacaggcactcaggagggcccggtaaaggctgagatgaagtggactgagtagaactggaggacaggagtcgacgtgagttcctgggagtctccagagatggggcctggaggcctggaggaaggggccaggcctcacattcgtggggctccctgaatggcagcctcagcacagcgtaggcccttaataaacacctgttggataagcca

SEQ ID NO: 6534 - DNA, 1020 bp, Homo sapiens; identical to SEQ ID NO: 6527

SEQ ID NO: 6535 - DNA, 888 bp, Homo sapiens; identical to SEQ ID NO: 6533

SEQ ID NO: 6536 - protein, 94 aa, Homo sapiens
MYVCAPVPHPDPPMALSRTPTRQIGSIDTDPPADGPSNPLCCCFHGPAFSTLNPVLRHLFPQEAFPAHPIYDLSQVWSVVSPAPSRGQALRRAR

SEQ ID NO: 6537 - DNA, 1174 bp, Homo sapiens
gacagtgaaccctgcgctgaaggcgttggggctcctgcagttctggggcagccacaggcgcccagggtttcgtgccgatcagcccaggacggtcttcccggtgcagtttctgatgcggggagggcagtgctgccttccggtcaccaggaccagtgctcagcccgcctgcttgacccccttacttagctggggtccaatccatacccaatttagatgattcagacgatgggatttgaaacttttgaactgggtgcgacttaagcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgccgccatccttgcgctgctccctgcactcggcctgctgctctggggacccggccagctataggctctggggggccccgctgcagcccacactgggtgtggtgccccaggcctctgtgccactcctcacacacccggcccagtgggagcctgtcctggttcctgaggcacatcctaacgcaagtctgaccatgtatgtctgcgcccctgtcccccaccctgaccctcccatggccctctccaggactcccacccggcagatcggctctattgacacagatccgcctgcagatggcccctccaaccctctctgctgctgtttccatggcccagcattctccacccttaaccctgtgctcaggcacctcttcccccaggaagccttccctgcccaccccatctatgacttgagccaggtctggtccgtggtgtcccccgcacccagcaggggacaggcactcaggagggcccggtaaaggctgagatgaagtggactgagtagaactggaggacaggagtcgacgtgagttcctgggagtctccagagatggggcctggaggcctggaggaaggggccaggcctcacattcgtggggctccctgaatggcagcctcagcacagcgtaggcccttaataaacacctgttggataagcca

SEQ ID NO: 6538 - DNA, 1020 bp, Homo sapiens; identical to SEQ ID NO: 6527

SEQ ID NO: 6539 - DNA, 1133 bp, Homo sapiens
tctggggcagccacaggcgcccagggtttcgtgccgatcagcccaggacggtcttcccggtgcagtttctgatgcggggagggcagtgctgccttccggtcaccaggaccagtgctcagcccgcctgcttgacccccttacttagctggggtccaatccatacccaatttagatgattcagacgatgggatttgaaacttttgaactgggtgcgacttaagcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgccgccatccttgcgctgctccctgcactcggcctgctgctctggggacccggccagctataggctctggggggccccgctgcagcccacactgggtgtggtgccccaggcctctgtgccactcctcacacacccggcccagtgggagcctgtcctggttcctgaggcacatcctaacgcaagtctgaccatgtatgtctgcgcccctgtcccccaccctgaccctcccatggccctctccaggactcccacccggcagatcggctctattgacacagatccgcctgcagatggcccctccaaccctctctgctgctgtttccatggcccagcattctccacccttaaccctgtgctcaggcacctcttcccccaggaagccttccctgcccaccccatctatgacttgagccaggtctggtccgtggtgtcccccgcacccagcaggggacaggcactcaggagggcccggtaaaggctgagatgaagtggactgagtagaactggaggacaggagtcgacgtgagttcctgggagtctccagagatggggcctggaggcctggaggaaggggccaggcctcacattcgtggggctccctgaatggcagcctcagcacagcgtaggcccttaataaacacctgttggataagcca

SEQ ID NO: 6540 - protein, 189 aa, Homo sapiens
MTHRTTTWARRTSRAVTPTCATPAGPMPCSRLPPSLRCSLHSACCSGDPASYRLWGAPLQPTLGVVPQASVPLLTHPAQWEPVLVPEAHPNASLTMYVCAPVPHPDPPMALSRTPTRQIGSIDTDPPADGPSNPLCCCFHGPAFSTLNPVLRHLFPQEAFPAHPIYDLSQVWSVVSPAPSRGQALRRAR

SEQ ID NO: 6541 - DNA, 1660 bp, Homo sapiens
gacagtgaaccctgcgctgaaggcgttggggctcctgcagttctggggcagccacaggcgcccagggtttcgtgccgatcagcccaggacggtcttcccggtgcagtttctgatgcggggagggcagtgctgccttccggtcaccaggaccagtgctcagcccgcctgcttgacccccttacttagctggggtccaatccatacccaatttagatgattcagacgatgggatttgaaacttttgaactgggtgcgacttaagcactgccctgctgtgctactcctgcaaagcccaggtgagcaacgaggactgcctgcaggtggagaactgcacccagctgggggagcagtgctggaccgcgcgcatccgtgagtggggggacgacagccgccaggcctaggtctctgccactgaactattaatctttctggccatctgtccgcatctgtgtgctgttttccttccacctgtccccgacccgtcccgcacctgcacccccaacaatcacccagcatctgtccctccagccatcctcctccatctgccactcctccactcatctgtccctccccatcctccatcttccactcctccacccatctgtccctccccatccctgagctcacttactcactcaccccatttctgacgctcagcgggtggtccatctgcctcggacatctggatagggctgagaccagggccgagaccaggccctcgcactgcttgcaatcctgaggccagcccagggggactctagagcattaggcagggtgggacaggaggaggcctggggcaggtcaggcaggtgagcacacagggcagccccatccccggatcccgctgctccccaggcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgccgccatccttgcgctgctccctgcactcggcctgctgctctggggacccggccagctataggctctggggggccccgctgcagcccacactgggtgtggtgccccaggcctctgtgccactcctcacacacccggcccagtgggagcctgtcctggttcctgaggcacatcctaacgcaagtctgaccatgtatgtctgcgcccctgtcccccaccctgaccctcccatggccctctccaggactcccacccggcagatcggctctattgacacagatccgcctgcagatggcccctccaaccctctctgctgctgtttccatggcccagcattctccacccttaaccctgtgctcaggcacctcttcccccaggaagccttccctgcccaccccatctatgacttgagccaggtctggtccgtggtgtcccccgcacccagcaggggacaggcactcaggagggcccggtaaaggctgagatgaagtggactgagtagaactggaggacaggagtcgacgtgagttcctgggagtctccagagatggggcctggaggcctggaggaaggggccaggcctcacattcgtggggctccctgaatggcagcctcagcacagcgtaggcccttaataaacacctgttggataagcca

SEQ ID NO: 6542 - DNA, 1020 bp, Homo sapiens; identical to SEQ ID NO: 6527

SEQ ID NO: 6543 - DNA, 1619 bp, Homo sapiens
tctggggcagccacaggcgcccagggtttcgtgccgatcagcccaggacggtcttcccggtgcagtttctgatgcggggagggcagtgctgccttccggtcaccaggaccagtgctcagcccgcctgcttgacccccttacttagctggggtccaatccatacccaatttagatgattcagacgatgggatttgaaacttttgaactgggtgcgacttaagcactgccctgctgtgctactcctgcaaagcccaggtgagcaacgaggactgcctgcaggtggagaactgcacccagctgggggagcagtgctggaccgcgcgcatccgtgagtggggggacgacagccgccaggcctaggtctctgccactgaactattaatctttctggccatctgtccgcatctgtgtgctgttttccttccacctgtccccgacccgtcccgcacctgcacccccaacaatcacccagcatctgtccctccagccatcctcctccatctgccactcctccactcatctgtccctccccatcctccatcttccactcctccacccatctgtccctccccatccctgagctcacttactcactcaccccatttctgacgctcagcgggtggtccatctgcctcggacatctggatagggctgagaccagggccgagaccaggccctcgcactgcttgcaatcctgaggccagcccagggggactctagagcattaggcagggtgggacaggaggaggcctggggcaggtcaggcaggtgagcacacagggcagccccatccccggatcccgctgctccccaggcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgccgccatccttgcgctgctccctgcactcggcctgctgctctggggacccggccagctataggctctggggggccccgctgcagcccacactgggtgtggtgccccaggcctctgtgccactcctcacacacccggcccagtgggagcctgtcctggttcctgaggcacatcctaacgcaagtctgaccatgtatgtctgcgcccctgtcccccaccctgaccctcccatggccctctccaggactcccacccggcagatcggctctattgacacagatccgcctgcagatggcccctccaaccctctctgctgctgtttccatggcccagcattctccacccttaaccctgtgctcaggcacctcttcccccaggaagccttccctgcccaccccatctatgacttgagccaggtctggtccgtggtgtcccccgcacccagcaggggacaggcactcaggagggcccggtaaaggctgagatgaagtggactgagtagaactggaggacaggagtcgacgtgagttcctgggagtctccagagatggggcctggaggcctggaggaaggggccaggcctcacattcgtggggctccctgaatggcagcctcagcacagcgtaggcccttaataaacacctgttggataagcca

SEQ ID NO: 6544 - protein, 189 aa, Homo sapiens; identical to SEQ ID NO: 6540

SEQ ID NO: 6545 - DNA, 1020 bp, Homo sapiens; identical to SEQ ID NO: 6527

SEQ ID NO: 6546 - protein, 114 aa, Homo sapiens
MAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

SEQ ID NO: 6547 - protein, 189 aa, Homo sapiens
MTHRTTTWARRTSRAVTPTCATPAGPMPCSRLLPSLRCSLHSACCSGDPASYRLWGAPLQPTLGVVPQASVPLLTHPAQWEPVLVPEAHPNASLTMYVCAPVPHPDPPMALSRTPTRQIGSIDTDPPADGPSNPLCCCFHGPAFSTLNPVLRHLFPQEAFPAHPIYDLSQVWSVVSPAPSRGQALRRAR

SEQ ID NO: 6548 - protein, 189 aa, Homo sapiens
MTHRTTTWARRTSRAVTPTCATPAGPMPCSRLPPSLRCSLHSACCSGDPASSRLWGAPLQPTLGVVPQASVPLLTHPAQWEPVLVPEAHPNASLTMYVCAPVPHPDPPMALSRTPTRQIGSIDTDPPADGPSNPLCCCFHGPAFSTLNPVLRHLFPQEAFPAHPIYDLSQVWSVVSPAPSRGQALRRAR

SEQ ID NO: 6549 - protein, 189 aa, Homo sapiens
MTHRTTTWARRTSRAVTPTCATPAGPMPCSRLPPSLRCSLHSACCSGDPASYRLWGAPLQPTLGVVPQASVPLLTDPAQWEPVLVPEAHPNASLTMYVCAPVPHPDPPMALSRTPTRQIGSIDTDPPADGPSNPLCCCFHGPAFSTLNPVLRHLFPQEAFPAHPIYDLSQVWSVVSPAPSRGQALRRAR

SEQ ID NO: 6550 - protein, 189 aa, Homo sapiens
MTHRTTTWARRTSRAVTPTCATPAGPMPCSRLPPSLRCSLHSACCSGDPASYRLWGAPLQPTLGVVPQASVPLLTHLAQWEPVLVPEAHPNASLTMYVCAPVPHPDPPMALSRTPTRQIGSIDTDPPADGPSNPLCCCFHGPAFSTLNPVLRHLFPQEAFPAHPIYDLSQVWSVVSPAPSRGQALRRAR

SEQ ID NO: 6551 - protein, 189 aa, Homo sapiens
MTHRTTTWARRTSRAVTPTCATPAGPMPCSRLPPSLRCSLHSACCSGDPASYRLWGAPLQPTLGVVPQASVPLLTHPAQWEPVLVPEAHPNASLTMYVCTPVPHPDPPMALSRTPTRQIGSIDTDPPADGPSNPLCCCFHGPAFSTLNPVLRHLFPQEAFPAHPIYDLSQVWSVVSPAPSRGQALRRAR

SEQ ID NO: 6552 - protein, 189 aa, Homo sapiens
MTHRTTTWARRTSRAVTPTCATPAGPMPCSRLPPSLRCSLHSACCSGDPASYRLWGAPLQPTLGVVPQASVPLLTHPAQWEPVLVPEAHPNASLTMYVCAPVPHPDPPMALSRTPTRQISSIDTDPPADGPSNPLCCCFHGPAFSTLNPVLRHLFPQEAFPAHPIYDLSQVWSVVSPAPSRGQALRRAR

SEQ ID NO: 6553 - protein, 189 aa, Homo sapiens
MTHRTTTWARRTSRAVTPTCATPAGPMPCSRLPPSLRCSLHSACCSGDPASYRLWGAPLQPTLGVVPQASVPLLTHPAQWEPVLVPEAHPNASLTMYVCAPVPHPDPPMALSRTPTRQIGSSDTDPPADGPSNPLCCCFHGPAFSTLNPVLRHLFPQEAFPAHPIYDLSQVWSVVSPAPSRGQALRRAR

SEQ ID NO: 6554 - protein, 189 aa, Homo sapiens
MTHRTTTWARRTSRAVTPTCATPAGPMPCSRLPPSLRCSLHSACCSGDPASYRLWGAPLQPTLGVVPQASVPLLTHPAQWEPVLVPEAHPNASLTMYVCAPVPHPDPPMALSRTPTRQIGSIDTDPPADGPSNPLCCCFHGPAFSTLNPVLRHLFPQEAFPAHPIYDLSQVWSVVSPAPSRGQALRRAQ

SEQ ID NO: 6555 - protein, 187 aa, Artificial Sequence
  Comparison PSCA variants
MTHRTTTWARRTSRAVTPTCATPAGPMPCSRLPSLRCSLHSACCSGDPASRLWGAPLQPTLGVVPQASVPLLTHPAQWEPVLVPEAHPNASLTMYVCAPVPHPDPPMALSRTPTRQIGSIDTDPPADGPSNPLCCCFHGPAFSTLNPVLRHLFPQEAFPAHPIYDLSQVWSVVSPAPSRGQALRRAR

SEQ ID NO: 6556 - protein, 189 aa, Homo sapiens
MTHRTTTWARRTSRAVTPTCATPAGPMPCSRLLPSLRCSLHSACCSGDPASSRLWGAPLQPTLGVVPQASVPLLTHPAQWEPVLVPEAHPNASLTMYVCAPVPHPDPPMALSRTPTRQIGSIDTDPPADGPSNPLCCCFHGPAFSTLNPVLRHLFPQEAFPAHPIYDLSQVWSVVSPAPSRGQALRRAR

SEQ ID NO: 6557 - protein, 11 aa, Homo sapiens
AGPDERHKSTC

The invention claimed is:

1. An isolated polynucleotide, wherein the polynucleotide is selected from the group consisting of:
a nucleotide sequence that encodes a PSCA protein comprising the amino acid sequence of SEQ ID NO: 6547, 6548, 6549, 6550, 6551, 6552, 6553, or 6554.

2. The isolated polynucleotide of claim 1, wherein the polynucleotide is selected from the group consisting of:
(a) a polynucleotide comprising the sequence of SEQ ID NO:6537, from nucleotide residue numbers 424 through 993, wherein the nucleotide residue at 521 is T;
(b) a polynucleotide comprising the sequence of SEQ ID NO:6537, from nucleotide residue numbers 424 through 993, wherein the nucleotide residue at 578 is C;
(c) a polynucleotide comprising the sequence of SEQ ID NO: 6537, from nucleotide residue numbers 424 through 993, wherein the nucleotide residue at 649 is G;
(d) a polynucleotide comprising the sequence of SEQ ID NO:6537, from nucleotide residue numbers 424 through 993, wherein the nucleotide residue at 653 is T;
(e) a polynucleotide comprising the sequence of SEQ ID NO: 6537, from nucleotide residue numbers 424 through 993, wherein the nucleotide residue at 721 is A;
(f) a polynucleotide comprising the sequence of SEQ ID NO: 6537, from nucleotide residue numbers 424 through 993, wherein the nucleotide residue at 781 is A;
(g) a polynucleotide comprising the sequence of SEQ ID NO:6537, from nucleotide residue numbers 424 through 993, wherein the nucleotide residue at 788 is G; and
(h) a polynucleotide comprising the sequence of SEQ ID NO:6537, from nucleotide residue numbers 424 through 993, wherein the nucleotide residue at 989 is A.

3. A recombinant expression vector comprising a polynucleotide of claim 2.

4. An isolated host cell that contains an expression vector of claim 3.

* * * * *

UNITED STATES PATENT AND TRADEMARK OFFICE
CERTIFICATE OF CORRECTION

PATENT NO. : 7,622,564 B2 Page 1 of 1
APPLICATION NO. : 10/857484
DATED : November 24, 2009
INVENTOR(S) : Ge et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 1330 days.

Signed and Sealed this

Second Day of November, 2010

David J. Kappos
*Director of the United States Patent and Trademark Office*